US009487563B2

(12) United States Patent
Nabel et al.

(10) Patent No.: US 9,487,563 B2
(45) Date of Patent: Nov. 8, 2016

(54) VIRUS-LIKE PARTICLES AND METHODS OF USE

(75) Inventors: Gary J. Nabel, Washington, DC (US); Srinivas Rao, Columbia, MD (US); Wataru Akahata, Kensington, MD (US)

(73) Assignee: The United States of America, as represented by the Secretary, Department of Health and Human Services, Washington, DC (US)

( * ) Notice: Subject to any disclaimer, the term of this patent is extended or adjusted under 35 U.S.C. 154(b) by 78 days.

(21) Appl. No.: 13/982,986

(22) PCT Filed: Jan. 31, 2012

(86) PCT No.: PCT/US2012/023361
§ 371 (c)(1),
(2), (4) Date: Dec. 27, 2013

(87) PCT Pub. No.: WO2012/106356
PCT Pub. Date: Aug. 9, 2012

(65) Prior Publication Data

US 2014/0170186 A1 Jun. 19, 2014

Related U.S. Application Data

(60) Provisional application No. 61/438,236, filed on Jan. 31, 2011, provisional application No. 61/501,012, filed on Jun. 24, 2011.

(51) Int. Cl.
*C07K 14/005* (2006.01)
*A61K 39/12* (2006.01)
*C12N 7/00* (2006.01)
*A61K 39/00* (2006.01)

(52) U.S. Cl.
CPC ............ *C07K 14/005* (2013.01); *A61K 39/12* (2013.01); *C12N 7/00* (2013.01); *A61K 2039/5258* (2013.01); *A61K 2039/53* (2013.01); *A61K 2039/55566* (2013.01); *C12N 2770/36123* (2013.01); *C12N 2770/36134* (2013.01); *C12N 2770/36151* (2013.01)

(58) Field of Classification Search
None
See application file for complete search history.

(56) References Cited

U.S. PATENT DOCUMENTS

2008/0226598 A1* 9/2008 Polo et al. .................. 424/93.2
2014/0170186 A1* 6/2014 Nabel et al. .............. 424/218.1

FOREIGN PATENT DOCUMENTS

WO WO 2010/062396 A2 6/2010

OTHER PUBLICATIONS

Tamm et al. (Journal of General Virology. 2008; 89: 676-686).*
Calisher et al. (Journal of General Virology. 1989; 70: 37-43.*
Sequence alignment of Seq ID No: 65 with Geneseq database access No. AYC84492 of Akahata et al. In WO 2010/062396 on Jun. 3, 2010.*
Li et al. (Virology. 1999; 264: 187-194).*
Akahata et al. (Journal of Virology. Aug. 2012; 86 (16: 8879-8883).*
Noranate et al. (PLoS. Sep. 2014; 9 (9): 1-7).*
Fields et al. (Virology. Oct. 2015; 486: 173-179).*
Palucha et al: "Virus-like particles: Models for assembly studies and foreign epitope carriers", Progress in Nucleic Acid Research and Molecular Biology, Academic Press, US. vol. 80, Jan. 1, 2005, pp. 135-168.
Chambers et al. "Flavivirus Genome Organiation, Expression, and Replication", Annual Review of Microbiology, Annual Revise, US. vol. 44, Jan. 1, 1990, pp. 649-688.
Yao et al. "Interactions between PE2, E1 and 6K required for assembly of alphaviruses studied with chimeric viruses", Journal of Virology, The American Society for Microbiology, US. vol. 70, No. 11, Nov. 1, 1996, pp. 7910-7920.
West et al.: "Mutations in the endodomain of Sindbis virus glycoprotein E2 define sequences critical for virus assembly", Journal of Virology. vol. 80, No. 9, May 2006, pp. 4458-4468.
International Search Report and Written Opinion prepared by the European Patent Office on Jan. 22, 2013, for International Application No. PCT/US2012/023361.

* cited by examiner

*Primary Examiner* — Shanon A Foley
(74) *Attorney, Agent, or Firm* — Sheridan Ross P.C.

(57) ABSTRACT

The invention features modified alphavirus or flavivirus virus-like particles (VLPs). The invention provides methods, compositions, and kits featuring the modified VLPs. The invention also features methods for enhancing production of modified VLPs for use in the prevention or treatment of alphavirus and flavivirus-mediated diseases. The invention also provides methods for delivering agents to a cell using the modified VLPs.

19 Claims, 177 Drawing Sheets

Figure 9A

```
37997       KDNFNVYKATRPYLAHCPDCGEGHSCHSPIALERIRNEATDGTLKIQVSLQIGIKTDDSH
OPY-1       KDNFNVYKATRPYLAHCPDCGEGHSCHSPVALERIRNEATDGTLKIQVSLQIGIKTDDSH
Ross River  TEHFNVYKATRPYLAYCADCGDGYFCYSPVAIEKIRDEASDGMLKIQVSAQIGLDKAGTH
Sindbis     IDDFT---LTSPYLGTCSYCHHTVPCFSPVKIEQVWDEADDNTIRIQTSAQFGYDQSGAA
WEEV        TDDFT---LTSPYLGFCPYCRHSAPCFSPIKIENVWDESDDGSIRIQVSAQFGYNQAGTA
EEEV        DTHFTQYKLARPYIADCPNCGHSR-CDSPIAIEEVRGDAHAGVIRIQTSAMFGLK----T
VEEV        EELFKEYKLTRPFMARCIRCAVG-SCHSPIAIEAVKSDGHDGYVRLQTSSQYGLDSSGNL
                *      **   *  *     * **   *             * *   *

37997       DWTKLRYMD---SHTPADAERAGLLVRTSAPCTITGTMGHFILARCPKGETLTVGFTDSR
OPY-1       DWTKLRYMD---NHMPADAERAGLFVRTSAPCTITGTMGHFILARCPKGETLTVGFTDSR
Ross River  AHTKIRYMA---GHDVQESKRDSLRVYTSAACSIHGTMGHFIVAHCPPGDYLKVSFEDAD
Sindbis     SANKYRYMSLKQDHTVKEGTMDDIKISTSGPCRRLSYKGYFLLAKCPPGDSVTVSIVSSN
WEEV        DVTKFRYMSYDHDHDIKEDSMEKLAISTSGPCRRLGHKGYFLLAQCPPGDSVTVSITSGA
EEEV        DGVDLAYMSFMNGKTQKSIKIDNLHVRTSAPCSLVSHHGYYILAQCPPGDTVTVGFHDGP
VEEV        ---KGRTMRYDMHGTIEEIPLHQVSLHTSRPCHIVDGHGYFLLARCPAGDSITMEFKKGS
                 *                       **  *        *     *  ** *

37997       KISHTCTHPFHHEPPVIGRERFHSRPQHGKELPCSTYVQSTAATAEEIEVHMPPDTPDRT
OPY-1       KISHSCTHPFHHDPPVIGREKFHSRPQHGKELPCSTYVQSTAATTEEIEVHMPPDTPDRT
Ross River  SHVKACKVQYKHDPLPVGREKFVVRPHFGVELPCTSYQLTTAPTDEEIDMHTPPDIPDRT
Sindbis     S-ATSCTLARKIKPKFVGREKYDLPPVHGKKIPCTVYDRLKETTAGYITMHRPRPHAYTS
WEEV        S-ENSCTVEKKIRRKFVGREEYLFPPVHGKLVKCHVYDHLKETSAGYITMHRPGPHAYKS
EEEV        N-RHTCTVAHKVEFRPVGREKYRHPPEHGVELPCNRYTHKRADQGHYVEMHQPGLVADHS
VEEV        V-THSCSVPYEVKFNPVGRELYTHPPEHGAEQACQVYAHDAQNRGAYVEMHLPGSEVDSS
               *           ***      *   *     *   *                 **
                                                                      233
                                                                        234
37997       LMTQQSGNVKITV-NGQTVRYKCNCGG-SNEGLTTTDKVINNC-KIDQCHAAVTNHKWQ
OPY-1       LMSQQSGNVKITV-NGQTVRYKCNCGG-SNEGLTTTDKVINNC-KVDQCHAAVTNHKWQ
Ross River  LLSQTAGNVKITA-GGRTIRYNCTCGR-DNVGTTSTDKTINTC-KIDQCHAAVTSHKWQ
Sindbis     YLEESSGKVYAKPPSGKNITYECKCGD-YKTGTVSTRTEITGCTAIKQCVAYKSDQTKWV
WEEV        YLEEASGEVYIKPPSGKNVTYECKCGD-YSTGIVSTRTKMNGCTKAKQCIAYKRDQTKWV
EEEV        LLSIHSAKVKITVPSGAQVKYYCKCPD-VREGTTSS-DYTTTCTDVKQCRAYLIDNKKWV
VEEV        LISLSGSSVTVTPPVGTSALVKCKCGGTKISETINKAKQFSQCTKKEQCRAYRLQNDKWV
                 *      *        * *                 *      ** *       *
                         251
37997       YNSPLVPRNAELGDRKGKIHIPFPLANVTCRVPKARNPTVTYGKNQVTMLLYPDHPTLLS
OPY-1       YNSPLVPRNAELGDRKGKIHIPFPLANVTCRVPKARNPTVTYGKNQVIMLLYPDHPTLLS
Ross River  FTSPFVPR-ADQTARRGKVHVPFPLTNVTCRVPLARAPDVTYGKKEVTLRLHPDHPTLFS
Sindbis     FNSPDLIR-HDDHTAQGKLHLPFKLIPSTCMVPVAHAPNVIHGFKHISLQLDTDHLTLLT
WEEV        FNSPDLIR-HTDHSVQGKLHIPFRLTPTVCPVPLAHTPTVTKWFKGITLHLTATRPTLLT
EEEV        YNSGRLPR-GEGDTFKGKLHVPFVPVKAKCIATLAPEPLVEHKHRTLILHLYPDHPTLLT
VEEV        YNSDKLPK-AAGATLKGKLHVPFLLADGKCTVPLAPEPMITFGFRSVSLKLHPKNPTYLT
      *                 ** *  **        *     *   *          *     *
```

Figure 10B

Insert C-E3-E2-6K-E1 (strain 37997)

atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctcgcagaaatcggaaaaacaagaagcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtgggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggagggggccaacgaaggtgcccgcacggccctctccgtggtgacgtggaacaaagacatcgtc
acaaaaattaccccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
tattacgaggctgcggcatatctatggaacgaacagcagcccctgttctggttgcaggctcttatcccgctggcc
gccttgatcgtcctgtgcaactgtctgaaactcttgccatgctgctgtaagaccctggctttttagccgtaatg
agcatcggtgcccacactgtgagcgcgtacgaacacgtaacagtgatcccgaacacggtgggagtaccgtataag
actcttgtcaacagaccgggttacagccccatggtgttggagatggagctacaatcagtcaccttggaaccaaca
ctgtcacttgactacatcacgtgcgagtacaaaactgtcatcccctccccgtacgtgaagtgctgtggtacagca
gagtgcaaggacaagagcctaccagactacagctgcaaggtctttactggagtctacccatttatgtggggcggc
gcctactgcttttgcgacgccgaaaatacgcaattgagcgaggcacatgtagagaaatctgaatcttgcaaaaca
gagtttgcatcggcctacagagcccacaccgcatcggcgtcggcgaagctccgcgtcctttaccaaggaaacaac
attaccgtagctgcctacgctaacggtgaccatgccgtcacagtaaaggacgccaagtttgtcgtgggcccaatg
tcctccgcctggacaccttttgacaacaaaatcgtggtgtacaaaggcgacgtctacaacatggactacccacct
tttggcgcaggaagaccaggacaatttggtgacattcaaagtcgtacaccggaaagtaaagacgtttatgccaac
actcagttggtactacagaggccagcagcaggcacggtacatgtaccatactctcaggcaccatctggcttcaag
tattggctgaaggaacgaggagcatcgctacagcacacggcaccgttcggttgccagattgcgacaaacccggta
agagctgtaaattgcgctgtggggaacataccaatttccatcgacataccggatgcggcctttactagggttgtc
gatgcaccctctgtaacggacatgtcatgcgaagtaccagcctgcactcactcctccgactttgggggcgtcgcc
atcatcaaatacacagctagcaagaaaggtaaatgtgcagtacattcgatgaccaacgccgttaccattcgagaa
gccgacgtagaagtagaggggaactcccagctgcaaatatccttctcaacagccctggcaagcgccgagtttcgc
gtgcaagtgtgctccacacaagtacactgcgcagccgcatgccaccctccaaaggaccacatagtcaattaccca
gcatcacacaccacccttggggtccaggatatatccacaacggcaatgtcttgggtgcagaagattacggagga
gtaggattaattgttgctgttgctgccttaattttaattgtggtgctatgcgtgtcgtttagcaggcactaa

Figure 10C

CMV/R 37997 C-E3-E2-6K-E1 tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctggccccacgccctacaattcaagtaattagacctagaccacgtccacagaggcaggctggg
caactcgcccagctgatctccgcagtcaacaaattgaccatgcgcgcggtacctcaacagaagcctcgcagaaat
cggaaaaacaagaagcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgagggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactcttgtcaacagaccgggttacagccccatggtgttggag
atggagctacaatcagtcaccttggaaccaacactgtcacttgactacatcacgtgcgagtacaaaactgtcatc
ccctccccgtacgtgaagtgctgtggtacagcagagtgcaaggacaagagcctaccagactacagctgcaaggtc
tttactggagtctacccatttatgtggggcggcgcctactgcttttgcgacgccgaaaatacgcaattgagcgag
gcacatgtagagaaatctgaatcttgcaaaacagagtttgcatcggcctacagagcccacaccgcatcggcgtcg
gcgaagctccgcgtcctttaccaaggaaacaacattaccgtagctgcctacgctaacggtgaccatgccgtcaca

Figure 10C continued gtaaaggacgccaagtttgtcgtgggcccaatgtcctccgcctggacaccttttgacaacaaaatcgtggtgtac
aaaggcgacgtctacaacatggactacccaccttttggcgcaggaagaccaggacaatttggtgacattcaaagt
cgtacaccggaaagtaaagacgtttatgccaacactcagttggtactacagaggccagcagcaggcacggtacat
gtaccatactctcaggcaccatctggcttcaagtattggctgaaggaacgaggagcatcgctacagcacacggca
ccgttcggttgccagattgcgacaaacccggtaagagctgtaaattgcgctgtggggaacataccaatttccatc
gacataccggatgcggcctttactagggttgtcgatgcaccctctgtaacggacatgtcatgcgaagtaccagcc
tgcactcactcctccgactttgggggcgtcgccatcatcaaatacacagctagcaagaaaggtaaatgtgcagta
cattcgatgaccaacgccgttaccattcgagaagccgacgtagaagtagaggggaactcccagctgcaaatatcc
ttctcaacagccctggcaagcgccgagtttcgcgtgcaagtgtgctccacacaagtacactgcgcagccgcatgc
caccctccaaaggaccacatagtcaattacccagcatcacacaccacccttggggtccaggatatatccacaacg
gcaatgtcttgggtgcagaagattacgggaggagtaggattaattgttgctgttgctgccttaattttaattgtg
gtgctatgcgtgtcgtttagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 11 B

Insert C-E3-E2-6K-E1 (strain OPY-1)

atggagttcatcccaacccaaactttttacaataggaggtaccagcctcgaccctggactccgcgccctactatc
caagtcatcaggcccagaccgcgccctcagaggcaagctgggcaacttgcccagctgatctcagcagttaataaa
ctgacaatgcgcgcggtaccacaacagaagccacgcaggaatcggaagaataagaagcaaaagcaaaaacaacag
gcgccacaaaacaacacaaatcaaaagaagcagccacctaaaaagaaaccggctcaaaagaaaaagaagccgggc
cgcagagagaggatgtgcatgaaaatcgaaaatgattgtattttcgaagtcaagcacgaaggtaaggtaacaggt
tacgcgtgcctggtgggggacaaagtaatgaaaccagcacacgtaaaggggaccatcgataacgcggacctggcc
aaactggcctttaagcggtcatctaagtatgaccttgaatgcgcgcagatacccgtgcacatgaagtccgacgct
tcgaagttcacccatgagaaaccggaggggtactacaactggcaccacggagcagtacagtactcaggaggccgg
ttcaccatccctacaggtgctggcaaaccaggggacagcggcagaccgatcttcgacaacaagggacgcgtggtg
gccatagtcttaggaggagctaatgaaggagcccgtacagccctctcggtggtgacctggaataaagacattgtc
actaaaatcacccccgaggggggccgaagagtggagtcttgccatcccagttatgtgcctgttggcaaacaccacg
ttcccctgctcccagccccccttgcacgccctgctgctacgaaaaggaaccggaggaaaccctacgcatgcttgag
gacaacgtcatgagacctgggtactatcagctgctacaagcatccttaacatgttctccccaccgccagcgacgc
agcaccaaggacaacttcaatgtctataaagccacaagaccatacttagctcactgtcccgactgtggagaaggg
cactcgtgccatagtcccgtagcactagaacgcatcagaaatgaagcgacagacgggacgctgaaaatccaggtc
tccttgcaaatcggaataaagacggatgacagccacgattggaccaagctgcgttatatggacaaccacatgcca
gcagacgcagagagggcggggctatttgtaagaacatcagcaccgtgtacgattactggaacaatgggacacttc
atcctggcccgatgtccaaaaggggaaactctgacggtgggattcactgacagtaggaagattagtcactcatgt
acgcacccatttcaccacgaccctcctgtgataggtcgggaaaaattccattcccgaccgcagcacggtaaagag
ctaccttgcagcacgtacgtgcagagcaccgccgcaactaccgaggagatagaggtacacatgcccccagacacc
cctgatcgcacattaatgtcacaacagtccggcaacgtaaagatcacagtcaatggccagacggtgcggtacaag
tgtaattgcggtggctcaaatgaaggactaacaactacagacaaagtgattaataactgcaaggttgatcaatgt
catgccgcggtcaccaatcacaaaaagtggcagtataactcccctctggtcccgcgtaatgctgaacttggggac
cgaaaaggaaaaattcacatcccgtttccgctggcaaatgtaacatgcagggtgcctaaagcaaggaaccccacc
gtgacgtacgggaaaaaccaagtcatcatgctactgtatcctgaccacccaacactcctgtcctaccggaatatg
ggagaagaaccaaactatcaagaagagtgggtgatgcataagaaggaagtcgtgctaaccgtgccgactgaaggg
ctcgaggtcacgtggggcaacaacgagccgtataagtattggccgcagttatctacaaacggtacagcccatggc
cacccgcatgagataattctgtattattatgagctgtaccccactatgactgtagtagttgtgtcagtggccacg
ttcatactcctgtcgatggtgggtatggcagcggggatgtgcatgtgtgcacgacgcagatgcatcacaccgtat
gaactgacaccaggagctaccgtccctttcctgcttagcctaatatgctgcatcagaacagctaaagcggccaca
taccaagaggctgcgatatacctgtggaacgagcagcaacctttgttttggctacaagcccttattccgctggca
gccctgattgttctatgcaactgtctgagactcttaccatgctgctgtaaaacgttggctttttagccgtaatg
agcgtcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgcgagtacaaaaccgtcatcccgtctccgtacgtgaagtgctgcggtacagca
gagtgcaaggacaaaaacctacctgactacagctgtaaggtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaaataac
atcactgtaactgcctatgcaaacggcgaccatgccgtcacagttaaggacgccaaattcattgtggggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactagggtcgtc
gacgcgccctctttaacggacatgtcgtgcgaggtaccagcctgcacccattcctcagactttgggggcgtcgcc
attattaaatatgcagccagcaagaaaggcaagtgtgcggtgcattcgatgactaacgccgtcactattcgggaa
gctgagatagaagttgaagggaattctcagctgcaaatctctttctcgacggccttagccagcgccgaattccgc
gtacaagtctgttctacacaagtacactgtgcagccgagtgccacccccccgaaggaccacatagtcaactacccg
gcgtcacataccaccctcggggtccaggacatctccgctacggcgatgtcatgggtgcagaagatcacgggaggt
gtgggactggttgttgctgttgccgcactgattctaatcgtggtgctatgcgtgtcgttcagcaggcac

Figure 11C

CMV/R C-E3-E2-6K-E1 strain OPY-1 tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccaacccaaactttttacaataggaggtac
cagcctcgaccctggactccgcgccctactatccaagtcatcaggcccagaccgcgccctcagaggcaagctggg
caacttgcccagctgatctcagcagttaataaactgacaatgcgcgcggtaccacaacagaagccacgcaggaat
cggaagaataagaagcaaaagcaaaaacaacaggcgccacaaaacaacacaaatcaaaagaagcagccacctaaa
aagaaaccggctcaaaagaaaaagaagccgggccgcagagagaggatgtgcatgaaaatcgaaaatgattgtatt
ttcgaagtcaagcacgaaggtaaggtaacaggttacgcgtgcctggtgggggacaaagtaatgaaaccagcacac
gtaaaggggaccatcgataacgcggacctggccaaactggcctttaagcggtcatctaagtatgaccttgaatgc
gcgcagatacccgtgcacatgaagtccgacgcttcgaagttcacccatgagaaaccggaggggtactacaactgg
caccacggagcagtacagtactcaggaggccggttcaccatccctacaggtgctggcaaaccaggggacagcggc
agaccgatcttcgacaacaagggacgcgtggtggccatagtcttaggaggagctaatgaaggagcccgtacagcc
ctctcggtggtgacctggaataaagacattgtcactaaaatcacccccgaggggggccgaagagtggagtcttgcc
atcccagttatgtgcctgttggcaaacaccacgttcccctgctcccagccccccttgcacgccctgctgctacgaa
aaggaaccggaggaaaccctacgcatgcttgaggacaacgtcatgagacctgggtactatcagctgctacaagca
tccttaacatgttctccccaccgccagcgacgcagcaccaaggacaacttcaatgtctataaagccacaagacca
tacttagctcactgtcccgactgtggagaagggcactcgtgccatagtcccgtagcactagaacgcatcagaaat
gaagcgacagacgggacgctgaaaatccaggtctccttgcaaatcggaataaagacggatgacagccacgattgg
accaagctgcgttatatggacaaccacatgccagcagacgcagagagggcggggctatttgtaagaacatcagca
ccgtgtacgattactggaacaatgggacacttcatcctggcccgatgtccaaaaggggaaactctgacggtggga
ttcactgacagtaggaagattagtcactcatgtacgcacccatttcaccacgaccctcctgtgataggtcgggaa
aaattccattcccgaccgcagcacggtaaagagctaccttgcagcacgtacgtgcagagcaccgccgcaactacc
gaggagatagaggtacacatgcccccagacacccctgatcgcacattaatgtcacaacagtccggcaacgtaaag
atcacagtcaatggccagacggtgcggtacaagtgtaattgcggtggctcaaatgaaggactaacaactacagac
aaagtgattaataactgcaaggttgatcaatgtcatgccgcggtcaccaatcacaaaaagtggcagtataactcc
cctctggtcccgcgtaatgctgaacttggggaccgaaaaggaaaaattcacatcccgtttccgctggcaaatgta
acatgcagggtgcctaaagcaaggaaccccaccgtgacgtacgggaaaaaccaagtcatcatgctactgtatcct
gaccacccaacactcctgtcctaccggaatatgggagaagaaccaaactatcaagaagagtgggtgatgcataag
aaggaagtcgtgctaaccgtgccgactgaagggctcgaggtcacgtggggcaacaacgagccgtataagtattgg
ccgcagttatctacaaacggtacagcccatggccacccgcatgagataattctgtattattatgagctgtacccc
actatgactgtagtagttgtgtcagtggccacgttcatactcctgtcgatggtgggtatggcagcggggatgtgc
atgtgtgcacgacgcagatgcatcacaccgtatgaactgacaccaggagctaccgtccctttcctgcttagccta
atatgctgcatcagaacagctaaagcggccacataccaagaggctgcgatatacctgtggaacgagcagcaacct
ttgttttggctacaagcccttattccgctggcagccctgattgttctatgcaactgtctgagactcttaccatgc
tgctgtaaaacgttggctttttagccgtaatgagcgtcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca

Figure 11C continued gttaaggacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttggggggcgtcgccattattaaatatgcagccagcaagaaaggcaagtgtgcggtg
cattcgatgactaacgccgtcactattcgggaagctgagatagaagttgaagggaattctcagctgcaaatctct
ttctcgacggccttagccagcgccgaattccgcgtacaagtctgttctacacaagtacactgtgcagccgagtgc
cacccccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaactttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 12A

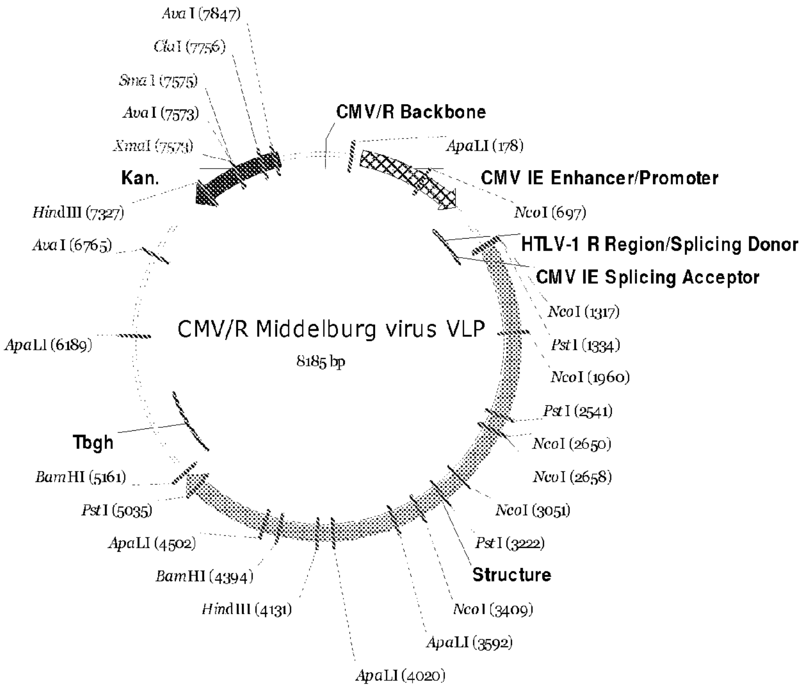

Figure 12B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcaatgaattacatacctacgcagacgttctacggccgccgatggcgtcctcgcccggcggcccgcccc
tgggtggctccaccacccgtatactatccaccaccgccacccgtgcctgtcgacccgcaagcgcagcaatgcaa
caacttattgctgcggtcaatacgctggctataaggcagaatggcacccgaacacctggacaacaacgaaggaaa
cgtcaatcaaacaaaccaaagaggaaacagacacccccgaagaaacagaacccggcgaaaacaaagaacaagcag
aaaccgcaaccacccaagcctaagaaacggaaacccggcaagagagaaaggaaatgcatgaagatagagaatgat
tgcatattcgaggtcaagctcgaaggcaaggtcactgggtacgcctgcctggtaggagataaagtgatgaaacca
gcacacgtgaaaggagtcatagataaccctgaccttgccaagctagcttttaagaaatcgagcaagtatgacctt
gagtgtgcgcaaattccggtccacatgaagtcagatgcctcgcagttcacccacgagaaaccagaaggacactac
aactggcaccatggtgcagtacaatacctgaacggaagatttaccatcccgacaggtgctgggaagccaggggac
agcggtaggcctatctttgacaacaagggtcgcgtagtggccattgtgctgggggggagccaacgagggagcgagg

Figure 12B continued acggctctatcggttgtcacctggaacaaagacatggttacgcgcatcaccccagaaggaactgaggagtggact
gccctggtgacaactgcttgcatcctgagcaatctgactttcgattgcagcctgccaccatgtgcgccttgctgc
tatgaaaaagacgcagagggcaccctgaggatgctggaggacaacgtcgataaccccggatactacgatctcctg
gctgcatcaacgcattgtgacgccccgcagcggcgtcgccgcaggggggctaactgaggactacgaggcttataaa
ctcactaagccgtacatagcctattgctctgactgcgggaacggacagttttgctacagcccgatagctattgag
agagtcagggccgaggcatcggacggaatgctcaagatacagatctctgcgcaaataggcctgcaggtggacgga
gctcatgcgtggacgaaaatcagatacatgaaagggcacgacgtggaggacacagacaggaactcactggaggtg
ttcaccaccggagagtgtacggtccatggcaccatggggcatttcatcgtagctacatgccccgaaggtgactcc
ttgacagtggcgttcgttgacaaacataaggtcaggcacgcttgcaggatagcatacaagcatcgtgtccccgta
ttgggcagagagcactttacggtacggccacatcatggagtagaattgccatgcaccacgtacgccatgagaaca
tcagtcactaccgaagaaatagaaatgcacgtggcgcatgacgtgcccgacaacacctttctatccaagaccgga
aataaagtgaagataacgccaaaaggaaagtctattcgctacaactgcacgtgtgggtctaaggagagcggtgtc
acaaagcaagacaaagaatttgacaactgcgaagtttcgcagtgccacaccatggtgaccgcccacgataagtgg
cagtttaactctccttatgtccctagggcaggctcaggcaagaaaggaaagatccacgtaccctttccactgagc
aactctacgtgcagagttccgttggcgcctttaccgaacaccatcccggcaaagaatggaatcacactgcagttg
catccggtcgccccgacgctacttacctaccgcaccctcggagagaaaccagaacaccacacagaatggatatca
gaaagttgcgaacgtacactccccgtacctgaggaggggttggagtacacatggggcaatcacgcccctgtgaga
ctgtgggcacaactgacgactaagggttcagcccatggatgccgcacgaaatcttctcatattactatggattg
taccctgccacgacggttgcagtgtgcgtggggctagcgtgtgtgatcttgctggctctgtccgcgtcctgctgc
ctgtgcgtgtcagcgagaaataagtgcttgaccccgtacgcgttgacgccaggagccgtggtgccgtgcactttg
agcttattgtgctgcgcccccagagccaaggccgcaacgtttgcggagacagcggcatatctatgggacgagaac
cagacggtgttctggatgcaattcgcaatccccgtagcatgctttatgatagtgacatattgcctgcgccacttg
atgctgtgctgtaggaccgcttctttttttagtggcagtaagcctgggaatgggggcgacccaggcgtatgagcat
agtgtaacgctccccaacgcggtcggatttccgtacagagcccatgtagacagaccagggttctctccattaacg
ctccatatggaggtagtctccactagcctagagccgacgctcgccctggattacgtcacttgcgagtacaaaacg
gtggtgccgtcgcctaaggtcacctgttgcggcatgtcggagtgtgcacaccagcaaaaagcggactttcaatgt
aaagtctacaccggcgtctaccccttttttgtggggcggtgcctactgcttttgcaattcggaaaacactcagctg
agcgaagcttatgttgagcggagcgaggtgtgcaaacacgatcacgcagcggcgtatcgcgctcatacagccgca
ttgaaggctaaaatcagagtgacctacggttccacgaacgggacggctgaggcgtttgtcaacggagagagcacc
gcacgaattggagacctgaaaatgatcctaggtcccatatccaccgcgtggagcccctttgacccaaagatcgtc
gtctacaaggacgaagtctacaatcaggattatccaccgtacggatccgggcaacccggtagatttggggactta
cagagcaggaccaccgagagtaacgatgtgtacgccaatactgcactgaagctggctcgcccatctgccggcacg
gtgcacgttccatatacccagacgccgtccgggtttaagtattggctaaaagaaaaaggggacgcattgaaccac
aaggctcctttcggctgcatcatcaagacgaaccccgtaagggcagaaaattgtgcagtcggaaacataccagtg
tctctagacattcccgacgcggcttttacacgcatagtcgacgcaccatcgctaaccggcctgaagtgcgaggtg
gcgacttgcacgcactcatcggactttggaggcactttggtggtggagtacaagaccgacaaagtggggacgtgc
gccgtccactcagaatccaacacggctgttatgcaggagacgagtctgtccgtgacgatggacggccgaggtacg
ttgcatttctccaccgcctcagcctcaccgtccttcgtactgaaagtgtgcagtagcaaaaccacttgcacagca
aagtgcgtgccgccgaaggaccacgtcgtcccttttcctgccaaccacaacaatgttgtgttcccggacttttcc
agtactgcagtgtcttggctcacccacactatgggcggagctactgtggtgattgctattgggatcaccatattc
ttaatagttacttgcatagcttttagtaggcactaggcggccgctctagaccaggccctggatccagatctgctg
tgccttctagttgccagccatctgttgtttgcccctcccccgtgccttccttgaccctggaaggtgccactccca
ctgtcctttcctaataaaatgaggaaattgcatcgcattgtctgagtaggtgtcattctattctggggggtgggg
tggggcaggacagcaagggggaggattgggaagacaatagcaggcatgctggggatgcggtgggctctatgggta
cccaggtgctgaagaattgacccggttcctcctgggccagaaagaagcaggcacatccccttctctgtgacacac
cctgtccacgcccctggttcttagttccagccccactcataggacactcatagctcaggagggctccgccttcaa
tcccacccgctaaagtacttggagcggtctctccctccctcatcagcccaccaaaccaaacctagcctccaagag
tgggaagaaattaaagcaagataggctattaagtgcagagggagagaaaatgcctccaacatgtgaggaagtaat
gagagaaatcatagaattttaaggccatgatttaaggccatcatggccttaatcttccgcttcctcgctcactga
ctcgctgcgctcggtcgttcggctgcggcgagcggtatcagctcactcaaaggcggtaatacggttatccacaga
atcaggggataacgcaggaaagaacatgtgagcaaaaggccagcaaaaggccaggaaccgtaaaaaggccgcgtt
gctggcgtttttccataggctccgcccccctgacgagcatcacaaaaatcgacgctcaagtcagaggtggcgaaa
cccgacaggactataaagataccaggcgtttccccctggaagctccctcgtgcgctctcctgttccgaccctgcc
gcttaccggatacctgtccgcctttctcccttcgggaagcgtggcgctttctcatagctcacgctgtaggtatct
cagttcggtgtaggtcgttcgctccaagctgggctgtgtgcacgaaccccccgttcagcccgaccgctgcgcctt
atccggtaactatcgtcttgagtccaacccggtaagacacgacttatcgccactggcagcagccactggtaacag
gattagcagagcgaggtatgtaggcggtgctacagagttcttgaagtggtggcctaactacggctacactagaag
aacagtatttggtatctgcgctctgctgaagccagttaccttcggaaaaagagttggtagctcttgatccggcaa
acaaaccaccgctggtagcggtggtttttttgtttgcaagcagcagattacgcgcagaaaaaaaggatctcaaga
agatcctttgatcttttctacggggtctgacgctcagtggaacgaaaactcacgttaagggattttggtcatgag
attatcaaaaaggatcttcacctagatcctttaaattaaaaatgaagttttaaatcaatctaaagtatatatga

Figure 12B continued gtaaacttggtctgacagttaccaatgcttaatcagtgaggcacctatctcagcgatctgtctatttcgttcatc
catagttgcctgactcggggggggggggcgctgaggtctgcctcgtgaagaaggtgttgctgactcataccaggc
ctgaatcgccccatcatccagccagaaagtgagggagccacggttgatgagagctttgttgtaggtggaccagtt
ggtgattttgaacttttgctttgccacggaacggtctgcgttgtcgggaagatgcgtgatctgatccttcaactc
agcaaaagttcgatttattcaacaaagccgccgtcccgtcaagtcagcgtaatgctctgccagtgttacaaccaa
ttaaccaattctgattagaaaaactcatcgagcatcaaatgaaactgcaatttattcatatcaggattatcaata
ccatatttttgaaaaagccgtttctgtaatgaaggagaaaactcaccgaggcagttccataggatggcaagatcc
tggtatcggtctgcgattccgactcgtccaacatcaatacaacctattaatttcccctcgtcaaaaataaggtta
tcaagtgagaaatcaccatgagtgacgactgaatccggtgagaatggcaaaagcttatgcatttctttccagact
tgttcaacaggccagccattacgctcgtcatcaaaatcactcgcatcaaccaaaccgttattcattcgtgattgc
gcctgagcgagacgaaatacgcgatcgctgttaaaaggacaattacaaacaggaatcgaatgcaaccggcgcagg
aacactgccagcgcatcaacaatattttcacctgaatcaggatattcttctaatacctggaatgctgttttcccg
gggatcgcagtggtgagtaaccatgcatcatcaggagtacggataaaatgcttgatggtcggaagaggcataaat
tccgtcagccagtttagtctgaccatctcatctgtaacatcattggcaacgctacctttgccatgtttcagaaac
aactctggcgcatcgggcttcccatacaatcgatagattgtcgcacctgattgcccgacattatcgcgagcccat
ttatacccatataaatcagcatccatgttggaatttaatcgcggcctcgagcaagacgtttcccgttgaatatgg
ctcataacaccccttgtattactgtttatgtaagcagacagttttattgttcatgatgatatatttttatcttgt
gcaatgtaacatcagagattttgagacacaacgtggctttccccccccccccccattattgaagcatttatcagggt
tattgtctcatgagcggatacatatttgaatgtatttagaaaaataaacaaataggggttccgcgcacatttccc
cgaaaagtgccacctgacgtctaagaaaccattattatcatgacattaacctataaaaataggcgtatcacgagg
ccctttcgtc

Figure 13A

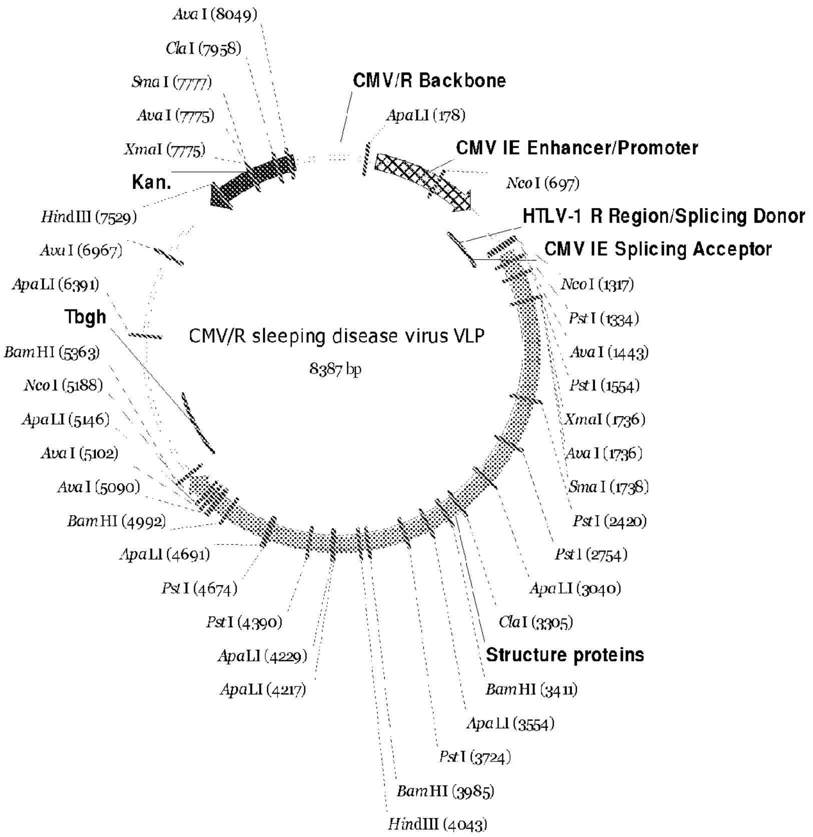

Figure 13B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttcccatgcaattcaccaactcagcctatcgccagatggagccc
atgttcgcaccggcttctcgaggacaagtacagccgtatcggccgcgcacaaagcgccgccaagagccgcaagtc
ggcaacgctgctattgctgccctcgcgaaccagatgagcgcgctccagctgcaggtggctggacttgccggccag
gcaagggtggaccgtcgtggaccgagacgtgttcagaaaaacaagcagaagaagaagaactcttccaacggagaa
aaacccaaggagaagaagaagaagcaaaaacaacaggagaagaaagggagcggcggtgaaaaagccaagaagccg
cggaaccggcccgggaaggaggtaaggatctccgtaaagcgtgcccgacagagcaccttccccgtgtaccatgac
ggtgccatatccggctatgcggtgctgattggctcccgcgtgtttaagccagcgcacgtgaagggtaagttcgac

Figure 13B continued cacccgaactggcggacatcaagttccaggtcgccgaggtcatggacctcgaagcagccgcataccctaagtgc
atgcgagaccaggcggctgaaccagcaaccatgatggatggagtgtacaatggggagtacggcaatattcaggag
tggaggacaattttgtattcgatgcgagcggcagaggcaagccggggtgacagtggcaggccattcaccgacaac
tcaggaaaggttgtcggtatcgtcctcggaggaggacccgatggtaggcgcacacgtctctccgtgataggtttc
gacaagaagctgaaggccagagagatcgcctacagcgaggccatcccttggacacgcgcaccagctctcctgctg
ctgcctatggtcatcgcctgcacctacaactccaatacctttgattgctccaaaccgtcctgccaggattgttgc
attactgctgaaccaaagaaggccatgactatgctgaaggacaacctgaatgacccgaactactgggacctgctc
attgccgtcaccacctgcagttccgcccgaaaaagagggctgtgtctacgtcgcctgtcgccgtttacgacaca
caaattctcgccgcccacgcagctgcctccccgtatagggcgtactgccccgattgtgacggaactgcctgcatc
tcgccgatagctatcgacgaggtggtaagtagcggtagtgaccacgtccttcgcatccgggtcggttctcaatcg
ggagtgaccgctaaaggcggtgcggcgggtgaaacctctctgcgatacctgggaagggacggtaaggtttacgcc
gcggacaacacgcggctcgtggtgcgcaccactgcaaagtgtgacgtgctgcaggccactggccactacattctg
gccaactgcccagtggggcagagtctcactgttgcggccacactggacggtacccggcatcaatgcaccacggtt
ttcgaacatcaagtaacggagaagttcacaagagaacgcagcaagggccaccacctgtccgatctgaccaagaaa
tgcaccaggttctccaccaccccgaagaagtccgcgctctatctcgttgatgtgtatgatgctctgccgacttct
gtagagatcagcaccgtggtgacatgcaacgaaagacagtgcacagtgagggtgccacccggtaccacagtgaaa
ttcgataagaggtgcaagaacgctgccaaagagaccgtcaccttcaccagcgactcccagacgtttacgtgcgag
gagccggtcctaacggccgccagcatcacccagggcaagccgcacctcagatcgtcaatgttgcccagcggaggc
aaagaggtgaaagcgaggattccattcccgttcccgccagagactgcgacttgcagagtgagcatcgccccactg
ccatcgattacctatgaggaaagcgatgttctgctggccggcactgcgaaataccccgtgctgctaactacacgg
aaccttggtttccatagcaacgccacatctgaatggatccagggtaagtacctgcgccgcatcccggtcacgccc
caagggattgaactaatgttggaaacaacgcaccgctgcacttctggtcatctgtcaggtacgcatctggagac
gccgacgcgtacccctgggaacttctggtgcaccacatcaagcaccatccggagtacgcgtgggcgtttgtagga
gttgcatgtggcctgctggccgttgcagcatgcatgttcgcgtgcgcatgcaacagggtgcggtactctctgctc
gccaacacgttcaacccgaacccaccaccattgaccgcactgactgcagcattgtgctgcatacctggggctcgc
gcggatcaaccctacctggacatcattgcctacttgtggaccaacagcaaagtggccttcgggctgcaatgcgcg
gcgcccgtggcttgcatgctcatcgttacatacgcccttagacattgcagattgtgctgcaattctttttaggg
gtaagagggtggtcggctctgctggtcatccttgcgtatgtacagagctgcaaggcgtacgaacacaccgtggtg
gtcccaatggatccaagagccccgtcgtacgaggcggtgataaaccggaatggtatgacccctgaagcttacc
atcgcagtgaactttaccgtcatctcaccaactacggctctggaatactggacctgtgcaggagtccctgtcgtc
gagccgccccatgtgggctgctgcacgtcagtgtcctgcccctccgacctctccacgctgcacgcgttcaccggc
aaagccgtctccgacgtgcactgcgatgtgcacacgaacgtgtaccccttgttgtggggtgcggctcactgcttc
tgttccactgaaaacacgcaggtcagcgctgtggccgccaccgtttctgagttctgtgctcaggactcagagcgc
gccgaggcgttcagcgttcacagcagctcagtcactgcagagattctcgtgacgcttggtgaagtggtgacggcg
gtccacgtttacgtggacggggtaacatcagccaggggtaccgacctcaagatcgtggctggcccaataacaact
gactactccccgtttgaccgcaaagtagtccgtatcggcgaagaggtctataattacgactggcctccttacggg
gctggtcgaccaggcacattcggagacattcaagctaggtcaaccaactatgtcaaacccaatgatctgtacggg
gacatcggaattgaagtactgcagccgactaatgaccacgtgcacgtggcttacacgtatacgacctctgggttg
ctgcgttggttgcaggacgctccgaaaccactcagtgtcacagcacccgcacggttgtaagatcagtgctaacccg
ctcctggccctcgattgtggggttggtgccgtccccatgtccatcaacattccggacgcgaagttcacccgcaaa
ctaaaggacccgaaaccttcggccctgaaatgcgtggtggacagttgcgagtacggggtggactacgggggcgcc
gccacgatcacctacgagggccacgaggctgggaagtgcgggatccattccctgacaccaggagtccctctgaga
acatcagtggttgaagtagttgccggcgctaataccgtcaaaacgaccttctcctcacccacgcccgaggttaca
ctcgaggtagagatctgttcggcaatagtgaagtgcgccagtgagtgcactccaccgaaggaacacgtagtcgca
gccaggcctcgccatggcagcgacactggaggctacatctccgggcccgcaatgcgctgggccggaaggattgta
gggaaccctagtggtcctgtttcctcatccttggccgtcacctactgcgtggtgaagaagtgccgctctaaaaga
atccggatagtcaagagctaatctagaccaggccctggatccagatctgctgtgccttctagttgccagccatct
gttgtttgcccctcccccgtgccttccttgaccctggaaggtgccactcccactgtcctttcctaataaaatgag
gaaattgcatcgcattgtctgagtaggtgtcattctattctggggggtggggtggggcaggacagcaagggggag
gattgggaagacaatagcaggcatgctggggatgcggtgggctctatgggtacccaggtgctgaagaattgaccc
ggttcctcctgggccagaaagaagcaggcacatccccttctctgtgacacaccctgtccacgcccctggttctta
gttccagccccactcataggacactcatagctcaggagggctccgccttcaatcccacccgctaaagtacttgga
gcggtctctccctccctcatcagcccaccaaaccaaacctagcctccaagagtgggaagaaattaaagcaagata
ggctattaagtgcagagggagagaaaatgcctccaacatgtgaggaagtaatgagagaaatcatagaattttaag
gccatgatttaaggccatcatggccttaatcttccgcttcctcgctcactgactcgctgcgctcggtcgttcggc
tgcggcgagcggtatcagctcactcaaaggcggtaatacggttatccacagaatcaggggataacgcaggaaaga
acatgtgagcaaaaggccagcaaaaggccaggaaccgtaaaaaggccgcgttgctggcgtttttccataggctcc
gcccccctgacgagcatcacaaaaatcgacgctcaagtcagaggtggcgaaacccgacaggactataaagatacc
aggcgtttccccctggaagctccctcgtgcgctctcctgttccgaccctgccgcttaccggatacctgtccgcct
ttctcccttcgggaagcgtggcgctttctcatagctcacgctgtaggtatctcagttcggtgtaggtcgttcgct
ccaagctgggctgtgtgcacgaaccccccgttcagcccgaccgctgcgccttatccggtaactatcgtcttgagt

Figure 13B continued ccaacccggtaagacacgacttatcgccactggcagcagccactggtaacaggattagcagagcgaggtatgtag
gcggtgctacagagttcttgaagtggtggcctaactacggctacactagaagaacagtatttggtatctgcgctc
tgctgaagccagttaccttcggaaaaagagttggtagctcttgatccggcaaacaaaccaccgctggtagcggtg
gtttttttgtttgcaagcagcagattacgcgcagaaaaaaaggatctcaagaagatcctttgatcttttctacgg
ggtctgacgctcagtggaacgaaaactcacgttaagggattttggtcatgagattatcaaaaaggatcttcacct
agatccttttaaattaaaaatgaagttttaaatcaatctaaagtatatatgagtaaacttggtctgacagttacc
aatgcttaatcagtgaggcacctatctcagcgatctgtctatttcgttcatccatagttgcctgactcgggggg
gggggcgctgagctctgcctcgtgaagaaggtgttgctgactcataccaggcctgaatcgccccatcatccagcc
agaaagtgagggagccacggttgatgagagctttgttgtaggtggaccagttggtgattttgaacttttgctttg
ccacggaacggtctgcgttgtcgggaagatgcgtgatctgatccttcaactcagcaaaagttcgatttattcaac
aaagccgccgtcccgtcaagtcagcgtaatgctctgccagtgttacaaccaattaaccaattctgattagaaaaa
ctcatcgagcatcaaatgaaactgcaatttattcatatcaggattatcaataccatatttttgaaaaagccgttt
ctgtaatgaaggagaaaactcaccgaggcagttccataggatggcaagatcctggtatcggtctgcgattccgac
tcgtccaacatcaatacaacctattaatttcccctcgtcaaaaataaggttatcaagtgagaaatcaccatgagt
gacgactgaatccggtgagaatggcaaaagcttatgcatttctttccagacttgttcaacaggccagccattacg
ctcgtcatcaaaatcactcgcatcaaccaaaccgttattcattcgtgattgcgcctgagcgagacgaaatacgcg
atcgctgttaaaaggacaattacaaacaggaatcgaatgcaaccggcgcaggaacactgccagcgcatcaacaat
attttcacctgaatcaggatattcttctaatacctggaatgctgttttcccggggatcgcagtggtgagtaacca
tgcatcatcaggagtacggataaaatgcttgatggtcggaagaggcataaattccgtcagccagtttagtctgac
catctcatctgtaacatcattggcaacgctacctttgccatgtttcagaaacaactctggcgcatcgggcttccc
atacaatcgatagattgtcgcacctgattgcccgacattatcgcgagcccatttatacccatataaatcagcatc
catgttggaatttaatcgcggcctcgagcaagacgtttcccgttgaatatggctcataacaccccttgtattact
gtttatgtaagcagacagttttattgttcatgatgatatatttttatcttgtgcaatgtaacatcagagattttg
agacacaacgtggctttcccccccccccccattattgaagcatttatcagggttattgtctcatgagcggatacat
atttgaatgtatttagaaaaataaacaaataggggttccgcgcacatttccccgaaaagtgccacctgacgtcta
agaaaccattattatcatgacattaacctataaaaataggcgtatcacgaggccctttcgtc

Figure 14A

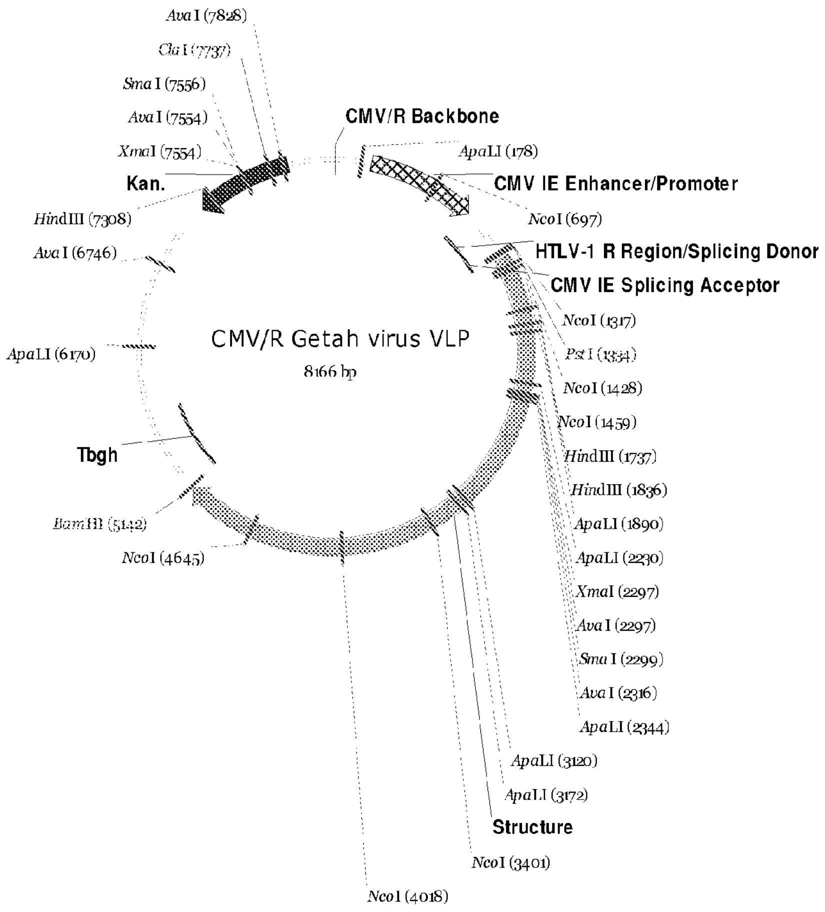

Figure 14B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcacaccatgaattacattccaactcaaaccttttacggacgccgttggcgaccacgcccggcgtaccg
tccatggcgggtgccgatgcagccggccccacccatggtgattcctgagctgcaaactccgatcgtccaggccca
acagatgcagcagctaatcagtgcagtttctgccctgacgaccaagcaaaatggcaaagcaccgaagaagccgaa
gaaaaagccgcaaaaagcgaaggctaagaaaaacgaacagcaaaagaagaacgagaacaagaaaccaccgcctaa

Figure 14B continued gcagaagaatccggctaagaagaagaaaccaggaaaaagggaacgcatgtgcatgaagatagagaatgattgcat
cttcgaggtcaagcttgacggtaaggtcacgggatacgcctgcctagtcggggataaagtgatgaagccggcaca
cgtcaaaggtgtgatcgacaaccccgacctagcgaagcttacctacaagaaatcgagcaagtatgacctggagtg
cgcccagataccagtgcacatgaagtcagatgcttcaaagtacacccatgaaaaaccagaagggcactacaattg
gcatcacggtgcagtgcagtacagcggtggcaggttcacaatcccgacaggcgcaggtaaaccaggagacagcgg
ccggccgatcttcgacaacaaaggacgcgtggtggccattgtcctgggaggggccaacgaaggagccaggactgc
cctatccgtcgtgacctggaccaaagacatggtcacacggtacaccccagaaggaacagaagaatggtccgccgc
cttgatgatgtgcgtcttagccaacgttacattcccatgctcagagcccgcgtgtgcaccctgttgctatgaaaa
acaaccagaacagacactgaggatgttagaggacaacgtggaccgcccgggctactacgacctgctcgaggccac
gatgacgtgtaacaatagtgcacgccaccgtcgcagtgtgacgaaacacttcaacgtctacaaggccacgaaacc
gtatctagcgtattgcgcggactgcggagacgggcagttctgttacagcccggtggctatagaaaaaattaggga
tgaggcttccgatggcatgataaaaatccaggtcgcagcgcaaattggcatcaacaaaggaggaacacacgaaca
caacaaaatcaggtacatcgccgggcatgacatgaaagaggcaaaccgggactctttacaagtgcatacttccgg
tgtgtgcgctattcgaggcacgatgggccacttcatcgtggcctactgccctccaggggacgaactaaaggtcca
gttccaagatgcagaatcgcacacccaggcctgcaaagtgcagtacaaacacgcaccggccccagtaggcagaga
aaaattcaccgtcaggccccacttcggtatcgaagtgccatgcacaacgtaccagctgactaccgcaccgacgga
ggaagagatcgacatgcataccccaccggatatcccagacataacgttgctgtcgcagcagtcaggtaatgtaaa
gatcacagcaggaggaaaaaccatcagatacaactgcacgtgtggtagtggcaacgtgggcaccaccagtagcga
caagactatcaattcgtgcaaaatagcacagtgccacgctgcggtgactaaccacgataagtggcagtacacctc
ctcgtttgtccctagagccgaccagttgtctcgcaaaggtaaagtgcacgtacctttccctctgaccaactccac
atgcagggtgcctgttgcacgtgcaccaggtgtcacatacggaaagagagaactgacagtgaaactgcacccaga
tcatcccacgctgttgacgtaccggagtctaggagcagatccgcgcccgtatgaggagtggatagaccgatacgt
cgaacggaccataccggtgaccgaagatgggatcgagtacagatggggaaacaacccacccgtgcgcttgtggc
ccagctgacaactgaaggcaaaccccatgggtggccgcacgagatcatactctattactatgggctatacccagc
agccaccatcgccgccgtctcagccgcgggtctcgcagtcgtactatcgctgctggcgtcatgttacatgttcgc
cactgcacgccgcaagtgcctgaccccatacgccctgaccccggagctgtcgtcccggtaacactaggagtact
atgctgcgcaccacgagcgcatgccgcgtcatttgcggaatctatggcgtatctatgggatgagaatcaaaccct
gttttggctggagcttgcaacgccgctcgctgccataatcatacttgtatgctgcctgaagaacctgctttgctg
ctgcaaaccgctttctttttagtgctggtgagcctgggaactcccgtcgtaaaatcttacgaacacaccgcaac
gatcccgaatgtggtgggattcccgtataaggctcacattgagaggaacggcttctccccgatgaccctacagct
tgaagtacttggaaccagcttggaacccacgctaaacttagagtacataacctgtgaatacaagacagtcgtgcc
atcaccttatatcaagtgctgcgggacatcagaatgcagatccatggagcgccccgactatcaatgccaggtcta
cacaggagtgtacccatttatgtggggcggcgcatactgcttctgcgacactgagaacacccagctgagtgaagc
atacgttgatagatcggacgtatgcaagcacgaccatgccgccgcctacaaggcgcatactgcggcaatgaaagc
caccatccgaataagctacgggaacctcaatcagacaacaacggcgttcgtcaacggggagcacacagtgaccgt
cggaggcagcaggtttacttttggtccaatctccactgcctggacgcctttcgacaacaagatcgtcgtctacaa
gaacgacgtctacaaccaggacttcccaccctacgcgtcaggacaaccagggaggtttggagacatccagagcag
gacggtagagagcaaggacctgtatgccaacaccgccctcaagttgtcaagaccttcgtccggtactgttcacgt
gccttacacacagaccccttctggctttaagtactcgataaaagagagaggcacgtcgctgaatgacaaggctcc
ctttggatgcgtaatcaagaccaacccagtcagagcagaaaattgcgccgttggcaacatcccagtctccatgga
catcccggacaccgcgtttacgcgcgtgattgatgcacctgccgtcacaaacctggagtgccaagtggcggtctg
cacgcactcatcggacttcggcgggatcgcgactctgactttcaaaactgacaaacccggaaaatgtgctgtcca
ttctcattcgaacgtagccaccatacaggaggcagctgtggacatcaaaacagatggcaagataaccctgcattt
ctctacagcatcagcatccccggcattcaaggtatctgtgtgcagtgccaaaacgacatgcatggcagcgtgtga
gccgccgaaggaccacatcgtcccttatggggcgagccataacaaccaagttttcctgacatgtctggcacggc
aatgacatgggtgcagcgggtagccggcggactcgccgggctaacactcgccgcagtggcagtacttatactggt
gacgtgtgtgactatgcgccgctaatctagaccagccctggatccagatctgctgtgccttctagttgccagcc
atctgttgtttgcccctcccccgtgccttccttgaccctggaaggtgccactcccactgtcctttcctaataaaa
tgaggaaattgcatcgcattgtctgagtaggtgtcattctattctggggggtggggtggggcaggacagcaaggg
ggaggattgggaagacaatagcaggcatgctggggatgcggtgggctctatgggtacccaggtgctgaagaattg
acccggttcctcctgggccagaaagaagcaggcacatccccttctctgtgacacaccctgtccacgcccctggtt
cttagttccagccccactcataggacactcatagctcaggagggctccgccttcaatcccacccgctaaagtact
tggagcggtctctccctccctcatcagcccaccaaaccaaacctagcctccaagagtgggaagaaattaaagcaa
gataggctattaagtgcagagggagagaaaatgcctccaacatgtgaggaagtaatgagagaaatcatagaattt
taaggccatgatttaaggccatcatggccttaatcttccgcttcctcgctcactgactcgctgcgctcggtcgtt
cggctgcggcgagcggtatcagctcactcaaaggcggtaatacggttatccacagaatcaggggataacgcagga
aagaacatgtgagcaaaaggccagcaaaaggccaggaaccgtaaaaaggccgcgttgctggcgtttttccatagg
ctccgcccccctgacgagcatcacaaaaatcgacgctcaagtcagaggtggcgaaacccgacaggactataaaga
taccaggcgtttccccctggaagctccctcgtgcgctctcctgttccgaccctgccgcttaccggatacctgtcc
gcctttctcccttcgggaagcgtggcgctttctcatagctcacgctgtaggtatctcagttcggtgtaggtcgtt
cgctccaagctgggctgtgtgcacgaaccccccgttcagcccgaccgctgcgccttatccggtaactatcgtctt

Figure 14B continued gagtccaacccggtaagacacgacttatcgccactggcagcagccactggtaacaggattagcagagcgaggtat
gtaggcggtgctacagagttcttgaagtggtggcctaactacggctacactagaagaacagtatttggtatctgc
gctctgctgaagccagttaccttcggaaaaagagttggtagctcttgatccggcaaacaaaccaccgctggtagc
ggtggtttttttgtttgcaagcagcagattacgcgcagaaaaaaaggatctcaagaagatcctttgatcttttct
acggggtctgacgctcagtggaacgaaaactcacgttaagggattttggtcatgagattatcaaaaaggatcttc
acctagatccttttaaattaaaaatgaagttttaaatcaatctaaagtatatatgagtaaacttggtctgacagt
taccaatgcttaatcagtgaggcacctatctcagcgatctgtctatttcgttcatccatagttgcctgactcggg
gggggggggcgctgaggtctgcctcgtgaagaaggtgttgctgactcataccaggcctgaatcgccccatcatcc
agccagaaagtgagggagccacggttgatgagagctttgttgtaggtggaccagttggtgattttgaacttttgc
tttgccacggaacggtctgcgttgtcgggaagatgcgtgatctgatccttcaactcagcaaaagttcgatttatt
caacaaagccgccgtcccgtcaagtcagcgtaatgctctgccagtgttacaaccaattaaccaattctgattaga
aaaactcatcgagcatcaaatgaaactgcaatttattcatatcaggattatcaataccatatttttgaaaaagcc
gtttctgtaatgaaggagaaaactcaccgaggcagttccataggatggcaagatcctggtatcggtctgcgattc
cgactcgtccaacatcaatacaacctattaatttcccctcgtcaaaaataaggttatcaagtgagaaatcaccat
gagtgacgactgaatccggtgagaatggcaaaagcttatgcatttctttccagacttgttcaacaggccagccat
tacgctcgtcatcaaaatcactcgcatcaaccaaaccgttattcattcgtgattgcgcctgagcgagacgaaata
cgcgatcgctgttaaaaggacaattacaaacaggaatcgaatgcaaccggcgcaggaacactgccagcgcatcaa
caatattttcacctgaatcaggatattcttctaatacctggaatgctgttttcccggggatcgcagtggtgagta
accatgcatcatcaggagtacggataaaatgcttgatggtcggaagaggcataaattccgtcagccagtttagtc
tgaccatctcatctgtaacatcattggcaacgctacctttgccatgtttcagaaacaactctggcgcatcgggct
tcccatacaatcgatagattgtcgcacctgattgcccgacattatcgcgagcccatttatacccatataaatcag
catccatgttggaatttaatcgcggcctcgagcaagacgtttcccgttgaatatggctcataacaccccttgtat
tactgtttatgtaagcagacagttttattgttcatgatgatatatttttatcttgtgcaatgtaacatcagagat
tttgagacacaacgtggctttcccccccccccccattattgaagcatttatcagggttattgtctcatgagcggat
acatatttgaatgtatttagaaaaataaacaaataggggttccgcgcacatttccccgaaaagtgccacctgacg
tctaagaaaccattattatcatgacattaacctataaaaataggcgtatcacgaggccctttcgtc

Figure 15A

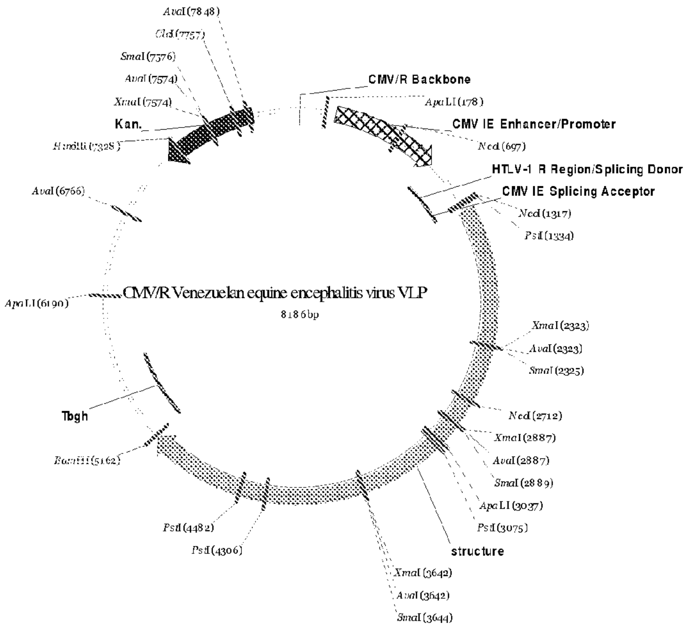

Figure 15B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccgttccaaccaatgtatccgatgcagccaatgccctatcgt
aacccgttcgcggccccgcgcaggccctggttccccagaaccgacccttttctggcgatgcaggtgcaggaatta
acccgctcgatggctaacctgacgttcaagcaacgccgggacgcgccacctgaggggccacctgctaagaaacct
aagagggaggccccgcaaaagcaaaaaggggaggccaagggaagaagaagaagaaccaggggaagaagaaggcc
aagacgggccgcctaatccgaaggcacagagtggaaacaagaagaagcccaacaagaaaccaggcaagagacag
cgcatggtcatgaaattggaatctgacaagacattcccaattatgctggaagggaagattaacggctacgcttgc
gtggtcggagggaagttattcaggccgatgcacgtggaaggcaagatcgacaacgacgttctggccgcacttaag
acgaagaaagcatccaaatatgatcttgagtatgcagatgtgccacagaacatgcgggccgatacattcaagtac
acccatgagaagccccaaggctattacagctggcatcatggagcagtccaatatgaaaatgggcgtttcacggtg
ccaaaaggagttggggccaagggagacagcggaagacccattctggataatcagggacgggtggtcgctattgtg
ctgggaggtgtgaatgaaggatctaggacagccctttcagtcgtcatgtggaacgagaagggagtaactgtgaag
tatactccggagaactgcgagcaatggtcactagtgaccactatgtgcctgctcgccaatgtgacgttcccatgt
gccgaaccaccaatttgctacgacagaaaaccagcagagactttggccatgctcagcgttaacgttgacaacccg

Figure 15B continued ggctacgatgagctgctggaagcagctgttaagtgccccggaagaaaaggagatctaccgaggagctgtttaag
gagtataagctaacgcgcccttacatggccagatgcatcagatgtgccgttgggagctgccatagtccaatagca
attgaggcagtgaagagcgacgggcacgacggctatgttagacttcagacttcctcgcagtatggcctggattcc
tctggcaacttaaagggaaggactatgcggtatgatatgcacgggaccattgaagagataccactacatcaagtg
tcactccacacatctcgcccgtgtcacattgtggatgggcatggttattttctgcttgctaggtgcccggcaggg
gactccatcaccatggaatttaagaaaggttcagtcacacactcctgctcagtgccgtatgaagtgaaatttaat
cctgtaggcagagaactctacactcatccaccagaacacggagcagagcaagcgtgccaagtctacgcgcacgat
gcacagaacagaggagcttatgtcgagatgcacctcccgggctcagaagtggacagcagtttgatttccttgagc
ggcagttcagtcaccgtgacacctcctgtcgggactagcgccttggtgaaatgcaagtgcggcggcacaaagatc
tccgaaaccatcaacaaggcaaaacagttcagccagtgcacaaagaaggagcagtgcagagcatatcgactgcag
aatgacaagtgggtgtataattctgacaaactgcccaaagcagcgggagccaccctaaaggaaaactacacgtc
ccgttcttgctggcagacggcaaatgcaccgtgcctctagcaccggaacctatgataaccttcggtttccgatca
gtgtcactgaaactgcaccctaagaatcccacatatctgaccactcgccaacttgctgatgagcctcattacacg
cacgagctcatatctgaaccagctgttaggaattttaccgtcactgaaaagggtgggagtttgtatggggaaac
catccgccgaaaaggttttgggcacaggaaacagcacccggaaatccacatggctgccacatgaggtgataact
cattattaccacagataccctatgtccaccatcctgggtttgtcaatttgcgccgccattgtaaccgtttccgtt
gcagcgtccacctggctgttttgcaaatccagagtttcgtgcctaactccttaccggctaacacctaacgccagg
atgccgctttgcctggccgtgctttgctgcgcccgcactgcccgggccgagaccacctgggagtccttggatcac
ctatggaacaataaccaacagatgttctggattcaattgctgatccctctggccgccttgattgtagtgactcgc
ctgctcaagtgcgtgtgctgtgtagtgcctttttttagtcgtggccggcgccgcaggcgccggcgcctacgagcac
gcgaccacgatgccgagccaagcgggaatctcgtataacaccatagtcaacagagcaggctacgcgccactccct
atcagcataacaccaacaaagatcaagctgatacccacagtgaacttggagtacgtcacctgccactacaaaaca
ggaatggattcaccagccatcaaatgctgcggatctcaggaatgtactccaactaacaggcctgatgaacagtgc
aaagtcttcacaggggtttacccgttcatgtggggaggtgcatattgcttttgcgacactgagaatactcaggtc
agcaaggcctacgtaatgaaatctgacgactgccttgcggatcatgctgaagcatacaaagcgcacacagcctca
gtgcaggcgttcctcaacatcacagtgggggaacactctattgtgaccaccgtgtatgtgaatggagaaactcct
gtgaacttcaatggggtcaaactaactgcaggtccactttccacagcttggacaccctttgacagaaaaatcgtg
cagtatgccggggagatctataattacgattttcctgagtatggggcaggacaaccaggagcatttggagacata
caatccagaacagtctcaagctcagatctgtatgccaataccaacctagtgctgcagagacccaaagcaggagcg
atccatgtgccatacactcaggcaccatcgggttttgagcaatggaagaaagataaagctccgtcattgaaattc
accgcccctttcggatgcgaaatatatacaaaccccattcgcgccgaaaattgtgctgtagggtcaattccatta
gcctttgacattcccgacgccttgttcaccagggtgtcagaaacaccgacactttcagcggccgaatgcactctt
aacgagtgcgtgtattcatccgactttggcgggatcgccacggtcaagtattcggccagcaagtcaggcaagtgc
gcagtccatgtgccatcagggactgctaccctaaaagaagcagcagtcgagctaaccgagcaaggtcggcgacc
attcatttctcgaccgcaaatatccacccggagttcaggctccaaatatgcacatcatatgtcacgtgcaaaggt
gattgtcaccccccgaaagaccacattgtgacacacccccagtatcacgcccaaacatttacagccgcggtgtca
aaaaccgcgtggacgtggttaacatccctgctgggaggatcggccgtaattattataattggcttagtgctggct
actattgtggccatgtacgtgctgaccaaccagaaacataattgatctagaccaggccctggatccagatctgct
gtgccttctagttgccagccatctgttgtttgcccctcccccgtgccttccttgaccctggaaggtgccactccc
actgtcctttcctaataaaatgaggaaattgcatcgcattgtctgagtaggtgtcattctattctggggggtggg
gtggggcaggacagcaagggggaggattgggaagacaatagcaggcatgctggggatgcggtgggctctatgggt
acccaggtgctgaagaattgacccggttcctcctgggccagaaagaagcaggcacatccccttctctgtgacaca
ccctgtccacgcccctggttcttagttccagccccactcataggacactcatagctcaggagggctccgccttca
atcccacccgctaaagtacttggagcggtctctccctccctcatcagcccaccaaaccaaacctagcctccaaga
gtgggaagaaattaaagcaagataggctattaagtgcagagggagagaaaatgcctccaacatgtgaggaagtaa
tgagagaaatcatagaattttaaggccatgatttaaggccatcatggccttaatcttccgcttcctcgctcactg
actcgctgcgctcggtcgttcggctgcggcgagcggtatcagctcactcaaaggcggtaatacggttatccacag
aatcaggggataacgcaggaaagaacatgtgagcaaaaggccagcaaaaggccaggaaccgtaaaaaggccgcgt
tgctggcgtttttccataggctccgcccccctgacgagcatcacaaaaatcgacgctcaagtcagaggtggcgaa
acccgacaggactataaagataccaggcgtttccccctggaagctccctcgtgcgctctcctgttccgaccctgc
cgcttaccggatacctgtccgcctttctcccttcgggaagcgtggcgctttctcatagctcacgctgtaggtatc
tcagttcggtgtaggtcgttcgctccaagctgggctgtgtgcacgaaccccccgttcagcccgaccgctgcgcct
tatccggtaactatcgtcttgagtccaacccggtaagacacgacttatcgccactggcagcagccactggtaaca
ggattagcagagcgaggtatgtaggcggtgctacagagttcttgaagtggtggcctaactacggctacactagaa
gaacagtatttggtatctgcgctctgctgaagccagttaccttcggaaaaagagttggtagctcttgatccggca
aacaaaccaccgctggtagcggtggtttttttgtttgcaagcagcagattacgcgcagaaaaaaaggatctcaag
aagatcctttgatcttttctacggggtctgacgctcagtggaacgaaaactcacgttaagggattttggtcatga
gattatcaaaaaggatcttcacctagatccttttaaattaaaaatgaagttttaaatcaatctaaagtatatatg
agtaaacttggtctgacagttaccaatgcttaatcagtgaggcacctatctcagcgatctgtctatttcgttcat
ccatagttgcctgactcggggggggggggcgctgaggtctgcctcgtgaagaaggtgttgctgactcataccagg
cctgaatcgccccatcatccagccagaaagtgagggagccacggttgatgagagctttgttgtaggtggaccagt

Figure 15B continued tggtgattttgaacttttgctttgccacggaacggtctgcgttgtcgggaagatgcgtgatctgatccttcaact
cagcaaaagttcgatttattcaacaaagccgccgtcccgtcaagtcagcgtaatgctctgccagtgttacaacca
attaaccaattctgattagaaaaactcatcgagcatcaaatgaaactgcaatttattcatatcaggattatcaat
accatatttttgaaaaagccgtttctgtaatgaaggagaaaactcaccgaggcagttccataggatggcaagatc
ctggtatcggtctgcgattccgactcgtccaacatcaatacaacctattaatttcccctcgtcaaaaataaggtt
atcaagtgagaaatcaccatgagtgacgactgaatccggtgagaatggcaaaagcttatgcatttctttccagac
ttgttcaacaggccagccattacgctcgtcatcaaaatcactcgcatcaaccaaaccgttattcattcgtgattg
cgcctgagcgagacgaaatacgcgatcgctgttaaaaggacaattacaaacaggaatcgaatgcaaccggcgcag
gaacactgccagcgcatcaacaatattttcacctgaatcaggatattcttctaatacctggaatgctgttttccc
ggggatcgcagtggtgagtaaccatgcatcatcaggagtacggataaaatgcttgatggtcggaagaggcataaa
ttccgtcagccagtttagtctgaccatctcatctgtaacatcattggcaacgctacctttgccatgtttcagaaa
caactctggcgcatcgggcttcccatacaatcgatagattgtcgcacctgattgcccgacattatcgcgagccca
tttatacccatataaatcagcatccatgttggaatttaatcgcggcctcgagcaagacgtttcccgttgaatatg
gctcataacaccccttgtattactgtttatgtaagcagacagttttattgttcatgatgatatatttttatcttg
tgcaatgtaacatcagagattttgagacacaacgtggctttccccccccccccattattgaagcatttatcaggg
ttattgtctcatgagcggatacatatttgaatgtatttagaaaaataaacaaataggggttccgcgcacatttcc
ccgaaaagtgccacctgacgtctaagaaaccattattatcatgacattaacctataaaaataggcgtatcacgag
gccctttcgtc

Figure 16A

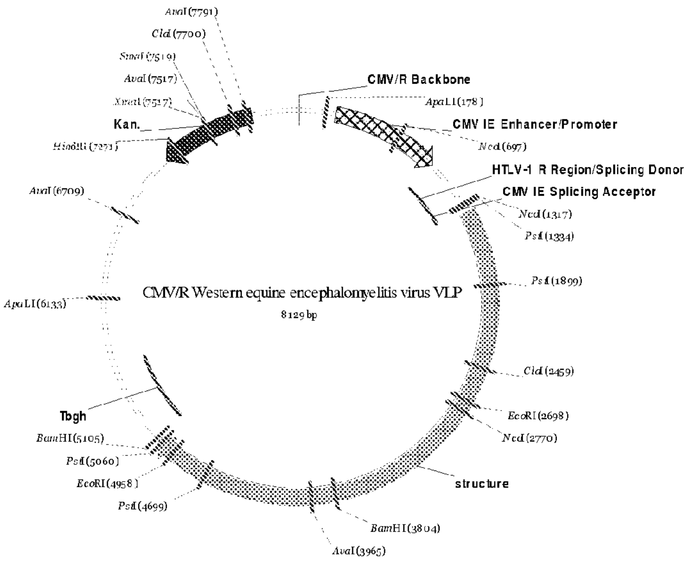

Figure 16B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttccataccctcagctgaactttccaccagtttaccctacaaat
ccgatggcttaccgagatccaaaccctcctaggcgccgctggaggccgtttcggcccccgctggctgctcaaatc
gaagatcttaggaggtcgatagtcaacttgactttcaaacaacgatcacctaatccgccgccaggtccaccgcca
aagaagaagaagagtgctcctaagccaaaacctactcagcctaaaaagaagaagcagcaagccaagaggacgaaa
cgcaagcctaaaccagggaaacgacaacgtatgtgtatgaagttggagtcggacaagacatttccgatcatgctg
aacggccaagtgaatggatatgcctgcgttgtcggaggaaggctgatgaaaccactccacgttgaaggaaaaatt
gataatgagcaattagcggccgtgaaattgaagaaggctagcatgtacgacttggagtacggcgacgttccccag
aacatgaaatcagacacgctgcagtacaccagcgacaaaccaccgggcttctacaactggcaccacggcgcagtc
cagtatgagaatgggagatttaccgtaccgagaggagtgggcgggaaaggcgacagcggaagaccgatcctggac
aacagaggcagagttgtggctattgttctaggaggtgcaaatgagggcacgcgtacggcgctttcagtggtcact
tggaaccagaaaggggtgaccattagggatacccccgaaggttctgaaccgtggtcactagttacagcgctatgc
gtgctttcgaatgtcacgttcccatgcgacaaaccacccgtgtgctattcactgacgccagaacgaacactcgac
gtgctcgaagagaacgtcgacaatccaaattacgacacgctgctggagaacgtcttgaaatgtccatcacgccgg
cccaaacgaagcattaccgatgacttcacactgaccagtccctacctggggttctgcccgtattgcagacactca
acgccgtgtttcagcccaataaaaattgagaacgtgtgggacgaatctgatgatggatcgattagaatccaggtc
tcggcacaattcggctacaatcaggcaggcactgcggatgtcaccaaattccgttacatgtctttcgaccacgac

Figure 16B continued

```
catgacatcaaggaagacagtatggagaaaatagctatcagcacatctggaccctgccgtcgtcttggccacaaa
gggtacttcctgttagctcaatgtcctccaggtgacagtgtaaccgtcagtatcacgagcggagcatctgagaat
tcatgcaccgtggagaaaaagatcaggaggaagtttgtcggtagagaggagtacttgttcccacccgtccatgga
aagctggtaaagtgccacgtttacgatcacttgaggagacgtctgccgggtacataaccatgcacaggccaggc
ccacacgcgtataagtcctatctggaggaagcgtcaggcgaagtgtacattaaaccaccttctggcaagaacgtc
acctacgaatgtaagtgtggcgactacagcacaggtatcgtgagcacgcgaacgaagatgaacggctgcactaaa
gcaaaacagtgcattgcctacaagagcgaccaaacgaaatgggtcttcaactcgccggatcttattaggcacaca
gaccactcagtgcaaggtaaattgcacattccattccgcttgacaccgacagtctgcccggttccgttagctcac
acgcctacagtcacgaagtggttcaaaggcatcaccctccacctgactgcaatgcgaccaacattgctgacaacg
agaaaattggggctgcgagcagacgcaacagcagaatggattacagggtctacatccaggaatttttctgtggg
cgagaagggctggagtacgtatggggtaaccatgaaccagtcagagtctgggcccaggagtcggcaccaggcgac
ccacatggatggccgcatgagatcatcatccactattatcatcggcatccagtctacactgtcattgtgctgtgt
ggtgtcgctcttgctatcctggtaggcactgcatcatcagcagcttgcatcgccaaagcaagaagagactgcctg
acgccatacgcgcttgcaccgaacgcaacggtacccacagcattagcggttttgtgctgcattcggccaaccaac
gctgaaacatttggagaaactttgaaccatctgtggtttaacaaccaaccgtttctctgggcacagttgtgcatt
cctctggcagcgcttgttattctgttccgctgcttttcatgctgcatgccttttttattggttgcaggcgtctgc
ctggggaaggtagacgccttcgaacatgcgaccactgtgccaaatgttccggggatcccgtataaggcgttggtc
gaacgcgcaggttacgcgccacttaacctggagatcacggtcgtctcatcggaattaacaccttcaactaacaag
gagtacgtgacctgcaaattccacacagtcattccttcaccacaagttaaatgctgcgggtccctcgagtgcaag
gcatcctcaaaggcggattacacatgccgcgttttggcggtgtgtacccttttcatgtggggaggcgcacaatgc
ttctgtgacagtgagaacacacaactgagtgaggcgtacgtcgagttcgctccagactgcactatagatcacgca
gtcgcactaaaagttcacacagctgctctgaaagtcggcctgcgtatagtatacggcaacaccaccgcgcacctg
gatacgtttgtcaatggcgtcacgccaggttcctcacgggacctgaaggtcatagcagggccgatatcagccgct
ttttcacccttttgaccataaggtcgtcatcagaaggggcttgtttacaactacgacttccctgagtatggagct
atgaaaccaggagcgttcggcgatattcaagcatcctcgcttgatgctacagacatagtagcccgcactgacata
cggctgctgaagcctctgtcaagaacatccacgtcccctacacccaagcagtatcagggtatgaaatgtggaag
aacaactcaggacgaccccctgcaagaaacagccacccattggatgtaaaattgaagtggagcctctgcgagcgtct
aactgtgcttacgggcacatccctatctcgattgacatccctgatgcagcttttgtgagatcatcagaatcacca
acaattttagaagttagctgcacagtagcagactgcatttattctgcagactttggtggttctctaacattacag
tacaaagctgacagggagggacattgtccagttcactccactccacgacagctgttttgaaggaagcgaccaca
catgtgactgccgtaggcagcataacactacattttagcacatcgagcccacaagcaaattttatagtttcgcta
tgcggcaagaagtccacctgcaatgctgaatgtaaaccaccggccgaccacataattggagaaccacataaagtc
gaccaagaattccaggcggcagtttccaaaacatcttggaactggctgcttgcactgtttggggagcatcatcc
ctcattgttgtaggacttatagtgttggtctgcagctctatgcttataaacacacgtagatgatctagaccaggc
cctggatccagatctgctgtgccttctagttgccagccatctgttgtttgccctccccgtgccttccttgacc
ctggaaggtgccactcccactgtcctttcctaataaaatgaggaaattgcatcgcattgtctgagtaggtgtcat
tctattctgggggtgggtggggcaggacagcaaggggaggattgggaagacaatagcaggcatgctgggat
ccggtgggctctatgggtacccaggtgctgaagaattgacccggttcctcctgggccagaaagaagcaggcacat
cccttctctgtgacacacctgtccacgcccctggttcttagttccagcccactcataggacactcatagctc
aggagggctccgccttcaatcccacccgctaaagtacttggagcggtctctccctccctcatcagcccaccaaac
caaacctagcctccaagagtgggaagaaattaaagcaagataggctattaagtgcagagggagagaaaatgcctc
caacatgtgaggaagtaatgagagaaatcatagaattttaaggccatgatttaaggccatcatggccttaatctt
ccgcttcctcgctcactgactcgctgcgctcggtcgttcggctgcggcagcggtatcagctcactcaaaggcgg
taatacggttatccacagaatcaggggataacgcaggaaagaacatgtgagcaaaaggccagcaaaaggccagga
accgtaaaaaggccgcgttgctggcgtttttccataggctccgcccccctgacgagcatcacaaaaatcgacgct
caagtcagaggtggcgaaacccgacaggactataaagataccaggcgtttccccctggaagctccctcgtgcgct
ctcctgttccgaccctgccgcttaccggatacctgtccgcctttctcccttcgggaagcgtggcgctttctcata
gctcacgctgtaggtatctcagttcggtgtaggtcgttcgctccaagctgggctgtgtgcacgaaccccccgttc
agcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggccta
actacggctacactagaagaacagtatttggtatctgcgctctgctgaagccagttaccttcggaaaaagagttg
gtagctcttgatccggcaaacaaaccaccgctggtagcggtggtttttttgtttgcaagcagcagattacgcgca
gaaaaaaggatctcaagaagatcctttgatcttttctacggggtctgacgctcagtggaacgaaaactcacgtt
aagggattttggtcatgagattatcaaaaaggatcttcacctagatccttttaaattaaaaatgaagttttaaat
caatctaaagtatatatgagtaaacttggtctgacagttaccaatgcttaatcagtgaggcacctatctcagcga
tctgtctatttcgttcatccatagttgcctgactcgggggggggggcgctgacgtctgcctcgtgaagaaggtg
ttgctgactcataccaggcctgaatcgccccatcatccagccagaaagtgagggagccacggttgatgagagctt
tgttgtaggtggaccagttggtgattttgaacttttgctttgccacggaacggtctgcgttgtcgggaagatgcg
tgatctgatccttcaactcagcaaagttcgatttattcaacaaagccgccgtcccgtcaagtcagcgtaatgct
ctgccagtgttacaaccaattaaccaattctgattagaaaaactcatcgagcatcaaatgaaactgcaatttatt
catatcaggattatcaataccatatttttgaaaaagccgtttctgtaatgaagcagaaaactcaccgaggcagtt
```

Figure 16B continued

```
ccataggatggcaagatcctggtatcggtctgcgattccgactcgtccaacatcaatacaacctattaatttccc
ctcgtcaaaaataaggttatcaagtgagaaatcaccatgagtgacgactgaatccggtgagaatggcaaaagctt
atgcatttctttccagacttgttcaacaggccagccattacgctcgtcatcaaaatcactcgcatcaaccaaacc
gttattcattcgtgattgcgcctgagcgagacgaaatacgcgatcgctgttaaaaggacaattacaaacaggaat
cgaatgcaaccggcgcaggaacactgccagcgcatcaacaatattttcacctgaatcaggatattcttctaatac
ctggaatgctgttttcccggggatcgcagtggtgagtaaccatgcatcatcaggagtacggataaaatgcttgat
ggtcggaagaggcataaattccgtcagccagtttagtctgaccatctcatctgtaacatcattggcaacgctacc
tttgccatgtttcagaaacaactctggcgcatcgggcttcccatacaatcgatagattgtcgcacctgattgccc
gacattatcgcgagcccatttatacccatataaatcagcatccatgttggaatttaatcgcggcctcgagcaaga
cgtttcccgttgaatatggctcataacaccccttgtattactgtttatgtaagcagacagttttattgttcatga
tgatatatttttatcttgtgcaatgtaacatcagagattttgagacacaacgtggctttccccccccccccatta
ttgaagcatttatcagggttattgtctcatgagcggatacatatttgaatgtatttagaaaaataaacaaatagg
ggttccgcgcacatttccccgaaaagtgccacctgacgtctaagaaaccattattatcatgacattaacctataa
aaataggcgtatcacgaggccctttcgtc
```

Figure 17A

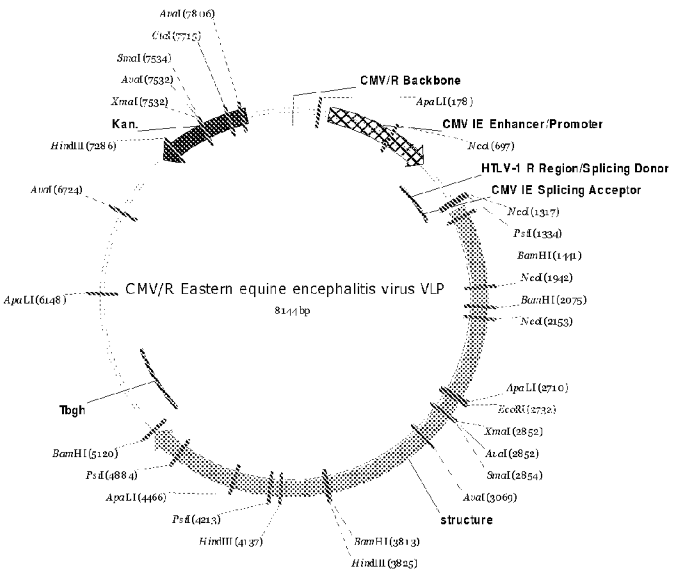

Figure 17B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccataccctacacttaactacccgcctatggcgccgattaac
ccgatggcttaccgggatcctaatccgcctaggcgcaggtggcggccctttaggccaccacttgcagctcaaatt
gaggacctgagacgttccatcgctaacctgactttgaaacaacgagcacctaaccctccagcaggaccgcccgcc
aaacgcaagaagcctgcgccaagcctaagcctgcgcaggaaaaagaagcgaccaccaccacctgccaagaaacaa
aaacgtaaacctaaaccaggcaaacgacagcgaatgtgtatgaagctagagtcagataaaacgtttccaatcatg
ttgaacggacaggtgaatggttacgcgtgcgtcgtgggtggacgagtgttcaaaccgctgcacgtagaaggcaga
atagacaatgagcaactggccgccatcaagctgaagaaggccagcatatatgaccttgagtatggtgatgtgcca
caatgcatgaaatcagataccctccagtacaccagtgacaagcctcctggcttttataactggcaccatggagct
gtacagtatgagaacaataggttcaccgtaccacggggggtcggtggaaagggtgacagcgggagacctattctt
gacaacaaaggtagagtcgtcgcaattgtcctgggtggagtcaacgaaggatccaggacggctctatcagtggtg
acatggaaccaaaaaggggttacagtcaaagatacaccagaggggtcagagccatggtcgcttgccactgtcatg
tgcgtcctggccaatatcacgtttccatgtgatcaaccaccctgcatgccatgctgttatgaaaagaatccacac
gaaacactcaccatgttggaacagaattacgacagccgagcctatgatcagctgctcgatgccgctgtgaaatgt
aatgctaggagaaccaggagagatttggacactcatttcacccagtataagctggcacgcccgtatattgctgat
tgccctaactgtgggcatagtcggtgcgacagccctatagctatagaagaagtcagaggggatgcgcacgcagga

Figure 17B continued gtcatccgcatccagacatcagctatgttcggtctgaagacggatggagttgatttggcctacatgagtttcatg
aacggcaaaacgcagaaatcaataaagatcgacaacctgcatgtgcgcacctcagccccttgttccctcgtgtcg
caccacggctattacatcctggctcaatgcccaccaggggacacggttacagttgggtttcacgacggcctaac
cgccatacgtgcacagttgcccataaggtagaattcaggccagtgggtagagagaaataccgtcacccacctgaa
catggagttgaattaccatgcaaccgttacacccacaagcgtgcagaccaaggacactacgttgagatgcatcaa
cccgggctagttgccgaccactctctccttagcatccacagtgccaaggtgaaaattacggtaccgagcggcgcc
caagtgaaatactactgcaagtgcccagacgtacgagagggaactaccagcagcgactatacaaccacctgcacg
gatgtcaaacaatgcagggcttacctgattgacaacaaaaaatgggtgtacaactctggaagactgcctcgagga
gagggcgacactttttaaaggaaacttcatgtgccctttgtgcctgttaaggccaagtgcatcgccacgctggca
ccagagcctctagttgagcacaaacaccgcaccctgattttacacctgtacccggaccacccgaccttgctgacg
accaggtcacttggaagtgatgcaaatccaactcgacaatggattgagcgaccaacaactgtcaatttcacagtc
accggagaagggttggagtatacctggggaaaccatccaccaaaaagagtatgggctcaagagtcaggagaaggg
aatccacatggatggccgcacgaagtggtagtctattactacaacagatacccattaaccacaattatcgggtta
tgcacctgtgtggctatcatcatggtctcttgtgtcacatccgtgtggctcctttgcaggactcgcaatctttgc
ataaccccgtataaactagccccgaacgctcaagtcccaatactcctggcgttactttgctgcattaagccgacg
agggcagatgacaccttgcaagtgctgaattacctgtggaacaacaatcaaaactttttctggatgcagacgctt
atcccacttgcagcgcttattgtatgcatgcgcatgctgcgctgcttattttgctgtgggccggctttttttactt
gtctgcggcgccttgggcgccccagcgtacgaacacacagcagtgatgccgaacaaggtggggatcccgtacaaa
gctttagtcgaacgcccaggttatgcacccgttcacctacagatacagctggttaataccaggataattccatca
actaacctgcagtacatcacctgcaagtataagacaaaagtgccttctccagtagtgaaatgctgcggtgccact
caatgtacctccaaaccccatcctgactatcagtgtcaggtgtttacaggtgtttacccattcatgtggggagga
gcctactgcttctgcgacactgaaaacacccagatgagcgaggcgtatgtagagcgctcggaagagtgctctatt
gaccacgcaaaagcttataaagtacacacaggcactgttcaggcaatggtgaacataacttatggagcgtcagc
tggagatctgcagatgtttacgtcaatggtgaaactcccgcgaaaataggagatgccaaactcatcataggtcca
ctgtcatctgcgtggtccccattcgataacaaggtggtggttcatgggcatgaagtgtataattacgactttcct
gagtacggcaccggcaaagcaggctcttttggagacctgcaatcacgcacatcaaccagcaacgatctgtacgca
aacaccaacttgaagctacaacgaccccaggctggtatcgtgcacacacctttcacccaggcgccctccggcttc
gaacgatggaaaaggcacaaaggggcaccgttgaacgacgtagccccgtttggctgttcgattgccctggagccg
ctccgtgcagaaaattgtgcagtgggaagcatccctatatctatagatatacccgatgcggcttttaccagaata
tctgaaacaccgacagtctcagacctggaatgcaaaattacggagtgtacttatgcctccgatttcggtggtata
gccaccgttgcctacaaatccagtaaagcaggaaactgtccaattcattctccatcaggtgttgcagttattaaa
gagaatgacgtcactcttgctgagagcggatcatttacattccacttctccactgcaaacatccatcctgctttt
aagctgcaggtctgcactagtgcagttacctgcaaaggagattgtaagccaccgaaagaccacatcgtcgattat
ccagcacaacatactgaatcctttacgtcggcgatatccgccactgcgtggtcgtggctaaaagtgctggtagga
ggaacatcagcatttatcgttctggggcttattgctacagcagtggttgccctagttctgttcttccatagacat
taatctagaccaggccctggatccagatctgctgtgccttctagttgccagccatctgttgtttgcccctccccc
gtgccttccttgaccctggaaggtgccactcccactgtcctttcctaataaaatgaggaaattgcatcgcattgt
ctgagtaggtgtcattctattctggggggtggggtggggcaggacagcaaggggaggattgggaagacaatagc
aggcatgctggggatgcggtgggctctatgggtacccaggtgctgaagaattgacccggttcctcctgggccaga
aagaagcaggcacatccccttctctgtgacacaccctgtccacgcccctggttcttagttccagccccactcata
ggacactcatagctcaggagggctccgccttcaatcccacccgctaaagtacttggagcggtctctccctccctc
atcagcccaccaaaccaaacctagcctccaagagtgggaagaaattaaagcaagataggctattaagtgcagagg
gagagaaaatgcctccaacatgtgaggaagtaatgagagaaatcatagaattttaaggccatgatttaaggccat
catggccttaatcttccgcttcctcgctcactgactcgctgcgctcggtcgttcggctgcggcgagcggtatcag
ctcactcaaaggcggtaatacggttatccacagaatcaggggataacgcaggaaagaacatgtgagcaaaaggcc
agcaaaaggccaggaaccgtaaaaaggccgcgttgctggcgtttttccataggctccgcccccctgacgagcatc
acaaaaatcgacgctcaagtcagaggtggcgaaacccgacaggactataaagataccaggcgtttccccctggaa
gctccctcgtgcgctctcctgttccgaccctgccgcttaccggatacctgtccgcctttctcccttcgggaagcg
tggcgctttctcatagctcacgctgtaggtatctcagttcggtgtaggtcgttcgctccaagctgggctgtgtgc
acgaaccccccgttcagcccgaccgctgcgccttatccggtaactatcgtcttgagtccaacccggtaagacacg
acttatcgccactggcagcagccactggtaacaggattagcagagcgaggtatgtaggcggtgctacagagttct
tgaagtggtggcctaactacggctacactagaagaacagtatttggtatctgcgctctgctgaagccagttacct
tcggaaaaagagttggtagctcttgatccggcaaacaaaccaccgctggtagcggtggtttttttgtttgcaagc
agcagattacgcgcagaaaaaaaggatctcaagaagatcctttgatcttttctacggggtctgacgctcagtgga
acgaaaactcacgttaagggattttggtcatgagattatcaaaaaggatcttcacctagatccttttaaattaaa
aatgaagttttaaatcaatctaaagtatatatgagtaaacttggtctgacagttaccaatgcttaatcagtgagg
cacctatctcagcgatctgtctatttcgttcatccatagttgcctgactcggggggggggggcgctgaggtctgc
ctcgtgaagaaggtgttgctgactcataccaggcctgaatcgccccatcatccagccagaaagtgagggagccac
ggttgatgagagctttgttgtaggtggaccagttggtgattttgaacttttgctttgccacggaacggtctgcgt
tgtcgggaagatgcgtgatctgatccttcaactcagcaaaagttcgatttattcaacaaagccgccgtcccgtca
agtcagcgtaatgctctgccagtgttacaaccaattaaccaattctgattagaaaaactcatcgagcatcaaatg

Figure 17B continued aaactgcaatttattcatatcaggattatcaataccatatttttgaaaaagccgtttctgtaatgaaggagaaaa
ctcaccgaggcagttccataggatggcaagatcctggtatcggtctgcgattccgactcgtccaacatcaataca
acctattaatttcccctcgtcaaaaataaggttatcaagtgagaaatcaccatgagtgacgactgaatccggtga
gaatggcaaaagcttatgcatttctttccagacttgttcaacaggccagccattacgctcgtcatcaaaatcact
cgcatcaaccaaaccgttattcattcgtgattgcgcctgagcgagacgaaatacgcgatcgctgttaaaaggaca
attacaaacaggaatcgaatgcaaccggcgcaggaacactgccagcgcatcaacaatattttcacctgaatcagg
atattcttctaatacctggaatgctgttttcccggggatcgcagtggtgagtaaccatgcatcatcaggagtacg
gataaaatgcttgatggtcggaagaggcataaattccgtcagccagtttagtctgaccatctcatctgtaacatc
attggcaacgctacctttgccatgtttcagaaacaactctggcgcatcgggcttcccatacaatcgatagattgt
cgcacctgattgcccgacattatcgcgagcccatttatacccatataaatcagcatccatgttggaatttaatcg
cggcctcgagcaagacgtttcccgttgaatatggctcataacaccccttgtattactgtttatgtaagcagacag
ttttattgttcatgatgatatattttttatcttgtgcaatgtaacatcagagattttgagacacaacgtggctttc
cccccccccccattattgaagcatttatcagggttattgtctcatgagcggatacatatttgaatgtatttagaa
aaataaacaaataggggttccgcgcacatttccccgaaaagtgccacctgacgtctaagaaaccattattatcat
gacattaacctataaaaataggcgtatcacgaggccctttcgtc

Figure 18A

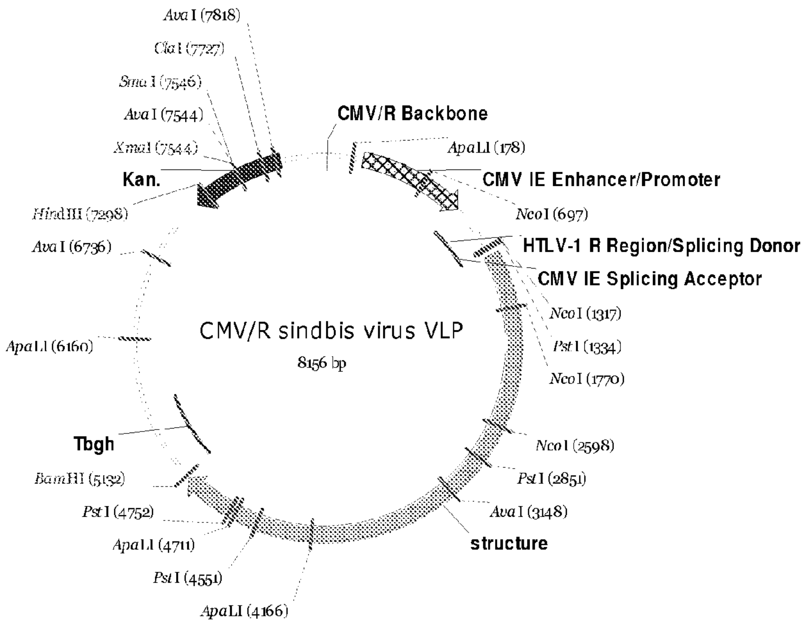

Figure 18B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgaatagaggattctttaacatgctcggccgccgccccttcccggcc
cccactgccatgtggaggccgcggagaaggaggcaggcggccccgatgcctgcccgcaacgggctggcttctcaa
atccagcaactgaccacagccgtcagtgccctagtcattggacaggcaactagacctcaacccccacgtccacgc
ccgccaccgcgccagaagaagcaggcgcccaagcaaccaccgaagccgaagaaaccaaaaacgcaggagaagaag
aagaagcaacctgcaaaacccaaacccggaaagagacagcgcatggcacttaagttggaggccgacagattgttc
gacgtcaagaacgaggacggagatgtcatcgggcacgcactggccatggaaggaaaggtaatgaaacctctgcac
gtgaaaggaaccatcgaccaccctgtgctatcaaagctcaaatttaccaagtcgtcagcatacgacatggagttc
gcacagttgccagtcaacatgagaagtgaggcattcacctacaccagtgaacaccccgaaggattctataactgg
caccacggagcggtgcagtatagtggaggtagatttaccatccctcgcggagtaggaggcagaggagacagcggt
cgtccgatcatggataactccggtcgggttgtcgcgatagtcctcggtggcgctgatgaaggaacacgaactgcc
ctttcggtcgtcacctggaatagtaaagggaagacaattaagacgaccccggaagggacagaagagtggtccgca
gcaccactggtcacggcaatgtgtttgctcggaaatgtgagcttcccatgcgaccgcccgcccacatgctatacc
cgcgaaccttccagagccctcgacatccttgaagagaacgtgaaccatgaggcctacgataccctgctcaatgcc
atattgcggtgcggatcgtctggcagaagcaaaagaagcgtcattgacgactttaccctgaccagcccctacttg

Figure 18B continued ggcacatgctcgtactgccaccatactgtaccgtgcttcagccctgttaagatcgagcaggtctgggacgaagcg
gacgataacaccatacgcatacagacttccgcccagtttggatacgaccaaagcggagcagcaagcgcaaacaag
taccgctacatgtcgcttaagcaggatcacaccgttaaagaaggcaccatggatgacatcaagattagcacctca
ggaccgtgtagaaggcttagctacaaaggatactttctcctcgcaaatgccctccaggggacagcgtaacggtt
agcatagtgagtagcaactcagcaacgtcatgtacactggcccgcaagataaaaccaaaattcgtgggacgggaa
aaatatgatctacctcccgttcacggtaaaaaattccttgcacagtgtacgaccgtctgaaagaaacaactgca
ggctacatcactatgcacaggccgagaccgcacgcttatacatcctacctggaagaatcatcaggaaagtttac
gcaaagccgccatctgggaagaacattacgtatgagtgcaagtgcggcgactacaagaccggaaccgtttcgacc
cgcaccgaaatcactggttgcaccgccatcaagcagtgcgtcgcctataagagcgaccaaacgaagtgggtcttc
aactcaccggacttgatcagacatgacgaccacacggcccaagggaaattgcatttgcctttcaagttgatcccg
agtacctgcatggtccctgttgcccacgcgccgaatgtaatacatggctttaaacacatcagcctccaattagat
acagaccacttgacattgctcaccaccaggagactaggggcaaacccggaaccaaccactgaatggatcgtcgga
aagacggtcagaaacttcaccgtcgaccgagatggcctggaatacatatggggaaatcatgagccagtgagggtc
tatgcccaagagtcagcaccaggagaccctcacggatggccacacgaaatagtacagcattactaccatcgccat
cctgtgtacaccatcttagccgtcgcatcagctaccgtggcgatgatcattggcgtaactgttgcagtgttatgt
gcctgtaaagcgcgccgtgagtgcctgacgccatacgccctggccccaaacgccgtaatcccaacttcgctggca
ctcttgtgctgcgttaggtcggccaatgctgaaacgttcaccgagaccatgagttacttgtggtcgaacagtcag
ccgttcttctgggtccagttgtgcatacctttggccgctttcatcgttctaatgcgctgctgctcctgctgcctg
cctttttagtggttgccggcgcctacctggcgaaggtagacgcctacgaacatgcgaccactgttccaaatgtg
ccacagataccgtataaggcacttgttgaaagggcagggtatgccccgctcaatttggagatcactgtcatgtcc
tcggaggttttgccttccaccaaccaagagtacattacctgcaaattcaccactgtggtccccctccccaaaatc
aaatgctgcggctccttggaatgtcagccggccgctcatgcagactatacctgcaaggtcttcggaggggtctac
ccctttatgtggggaggagcgcaatgtttttgcgacagtgagaacagccagatgagtgaggcgtacgtcgaattg
tcagcagattgcgcgtctgaccacgcgcaggcgattaaggtgcacactgccgcgatgaaagtaggactgcgtatt
gtgtacgggaacactaccagtttcctagatgtgtacgtgaacggagtcacaccaggaacgtctaaagacttgaaa
gtcatagctggaccaatttcagcatcgtttacgccattcgatcataaggtcgttatccatcgcggcctggtgtac
aactatgacttcccggaatatggagcgatgaaaccaggagcgtttggagacattcaagctacctccttgactagc
aaggatctcatcgccagcacagacattaggctactcaagccttccgccaagaacgtgcatgtcccgtacacgcag
gcctcatcaggatttgagatgtggaaaaacaactcaggccgcccactgcaggaaaccgcacctttcgggtgtaag
attgcagtaaatccgctccgagcggtggactgttcatacgggaacattcccatttctattgacatcccgaacgct
gcctttatcaggacatcagatgcaccactggtctcaacagtcaaatgtgaagtcagtgagtgcacttattcagca
gacttcggcgggatggccaccctgcagtatgtatccgaccgcgaaggtcaatgccccgtacattcgcattcgagc
acagcaactctccaagagtcgacagtacatgtcctggagaaaggagcggtgacagtacactttagcaccgcgagt
ccacaggcgaactttatcgtatcgctgtgtgggaagaagacaacatgcaatgcagaatgtaaaccaccagctgac
catatcgtgagcaccccgcacaaaaatgaccaagaatttcaagccgccatctcaaaaacatcatggagttggctg
tttgcccttttcggcggcgcctcgtcgctattaattataggacttatgattttgcttgcagcatgatgctgact
agcacacgaagatgatctagaccaggccctggatccagatctgctgtgccttctagttgccagccatctgttgtt
tgcccctcccccgtgccttccttgaccctggaaggtgccactcccactgtcctttcctaataaaatgaggaaatt
gcatcgcattgtctgagtaggtgtcattctattctggggggtggggtggggcaggacagcaagggggaggattgg
gaagacaatagcaggcatgctggggatgcggtgggctctatgggtacccaggtgctgaagaattgacccggttcc
tcctgggccagaaagaagcaggcacatccccttctctgtgacacaccctgtccacgcccctggttcttagttcca
gccccactcataggacactcatagctcaggagggctccgccttcaatcccacccgctaaagtacttggagcggtc
tctccctccctcatcagcccaccaaaccaaacctagcctccaagagtgggaagaaattaaagcaagataggctat
taagtgcagagggagagaaaatgcctccaacatgtgaggaagtaatgagagaaatcatagaattttaaggccatg
atttaaggccatcatggccttaatcttccgcttcctcgctcactgactcgctgcgctcggtcgttcggctgcggc
gagcggtatcagctcactcaaaggcggtaatacggttatccacagaatcaggggataacgcaggaaagaacatgt
gagcaaaaggccagcaaaaggccaggaaccgtaaaaaggccgcgttgctggcgtttttccataggctccgccccc
ctgacgagcatcacaaaaatcgacgctcaagtcagaggtggcgaaacccgacaggactataaagataccaggcgt
ttccccctggaagctccctcgtgcgctctcctgttccgaccctgccgcttaccggatacctgtccgcctttctcc
cttcgggaagcgtggcgctttctcatagctcacgctgtaggtatctcagttcggtgtaggtcgttcgctccaagc
tgggctgtgtgcacgaaccccccgttcagcccgaccgctgcgccttatccggtaactatcgtcttgagtccaacc
cggtaagacacgacttatcgccactggcagcagccactggtaacaggattagcagagcgaggtatgtaggcggtg
ctacagagttcttgaagtggtggcctaactacggctacactagaagaacagtatttggtatctgcgctctgctga
agccagttaccttcggaaaaagagttggtagctcttgatccggcaaacaaaccaccgctggtagcggtggttttt
ttgtttgcaagcagcagattacgcgcagaaaaaaaggatctcaagaagatcctttgatcttttctacggggtctg
acgctcagtggaacgaaaactcacgttaagggattttggtcatgagattatcaaaaaggatcttcacctagatcc
ttttaaattaaaaatgaagttttaaatcaatctaaagtatatatgagtaaacttggtctgacagttaccaatgct
taatcagtgaggcacctatctcagcgatctgtctatttcgttcatccatagttgcctgactcggggggggggggc
gctgaggtctgcctcgtgaagaaggtgttgctgactcataccaggcctgaatcgccccatcatccagccagaaag
tgagggagccacggttgatgagagctttgttgtaggtggaccagttggtgattttgaacttttgctttgccacgg
aacggtctgcgttgtcgggaagatgcgtgatctgatccttcaactcagcaaaagttcgatttattcaacaaagcc

Figure 18B continued gccgtcccgtcaagtcagcgtaatgctctgccagtgttacaaccaattaaccaattctgattagaaaaactcatc
gagcatcaaatgaaactgcaatttattcatatcaggattatcaataccatatttttgaaaaagccgtttctgtaa
tgaaggagaaaactcaccgaggcagttccataggatggcaagatcctggtatcggtctgcgattccgactcgtcc
aacatcaatacaacctattaatttcccctcgtcaaaaataaggttatcaagtgagaaatcaccatgagtgacgac
tgaatccggtgagaatggcaaaagcttatgcatttctttccagacttgttcaacaggccagccattacgctcgtc
atcaaaatcactcgcatcaaccaaaccgttattcattcgtgattgcgcctgagcgagacgaaatacgcgatcgct
gttaaaaggacaattacaaacaggaatcgaatgcaaccggcgcaggaacactgccagcgcatcaacaatatttc
acctgaatcaggatattcttctaatacctggaatgctgttttcccggggatcgcagtggtgagtaaccatgcatc
atcaggagtacggataaaatgcttgatggtcggaagaggcataaattccgtcagccagtttagtctgaccatctc
atctgtaacatcattggcaacgctacctttgccatgtttcagaaacaactctggcgcatcgggcttcccatacaa
tcgatagattgtcgcacctgattgcccgacattatcgcgagcccatttatacccatataaatcagcatccatgtt
ggaatttaatcgcggcctcgagcaagacgtttcccgttgaatatggctcataacaccccttgtattactgtttat
gtaagcagacagttttattgttcatgatgatatatttttatcttgtgcaatgtaacatcagagattttgagacac
aacgtggctttccccccccccccattattgaagcatttatcagggttattgtctcatgagcggatacatatttga
atgtatttagaaaaataaacaaataggggttccgcgcacatttccccgaaaagtgccacctgacgtctaagaaac
cattattatcatgacattaacctataaaaataggcgtatcacgaggccctttcgtc

Figure 19A

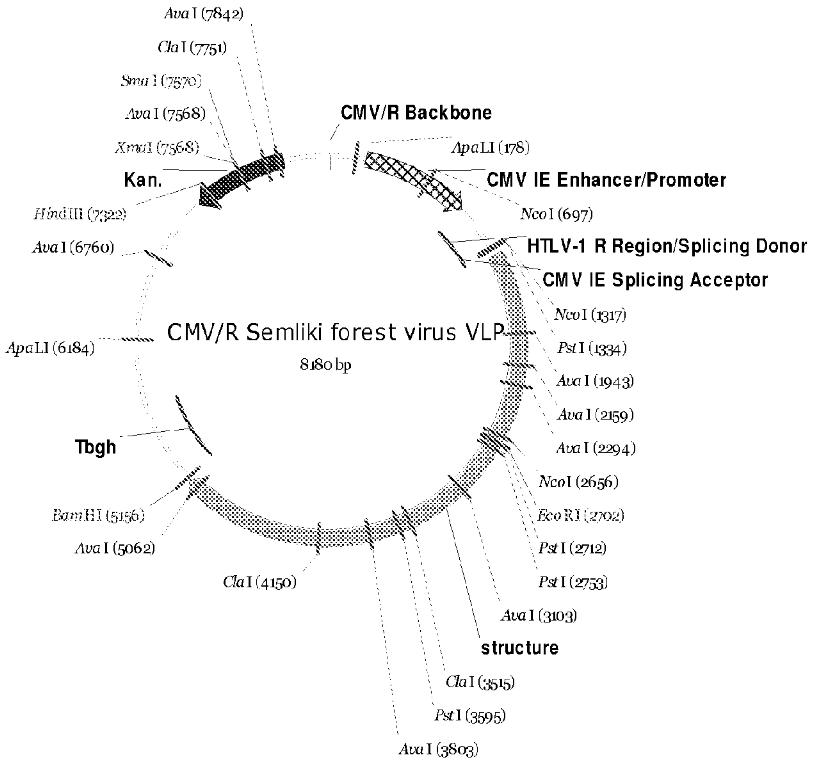

Figure 19B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgaattacatccctacgcaaacgttttacggccgccggtggcgcccg
cgcccggcggcccgtccttggccgttgcaggccactccggtggctcccgtcgtccccgacttccaggcccagcag
atgcagcaactcatcagcgccgtaaatgcgctgacaatgagacagaacgcaattgctcctgctaggcctcccaaa
ccaaagaagaagaagacaaccaaaccaaagccgaaaacgcagcccaagaagatcaacggaaaaacgcagcagcaa
aagaagaaagacaagcaagccgacaagaagaagaaacccggaaaaagagaaagaatgtgcatgaagattgaa
aatgactgtatcttcgaagtcaaacacgaaggaaaggtcactgggtacgcctgcctggtgggcgacaaagtcatg
aaacctgcccacgtgaaaggagtcatcgacaacgcggacctggcaaagctagctttcaagaaatcgagcaagtat
gaccttgagtgtgcccagataccagttcacatgaggtcggatgcctcaaagtacacgcatgagaagcccgaggga
cactataactggcaccacggggctgttcagtacagcggaggtaggttcactataccgacaggagcgggcaaaccg

Figure 19B continued ggagacagtggccggcccatctttgacaacaagggggagggtagtcgctatcgtcctgggcggggccaacgagggc
tcacgcacagcactgtcggtggtcacctggaacaaagatatggtgactagagtgacccccgagggtccgaagag
tggtccgccccgctgattactgccatgtgtgtccttgccaatgctaccttcccgtgcttccagcccccgtgtgta
ccttgctgctatgaaaacaacgcagaggccacactacggatgctcgaggataacgtggataggccagggtactac
gacctccttcaggcagccttgacgtgccgaaacggaacaagacaccggcgcagcgtgtcgcaacacttcaacgtg
tataaggctacacgcccttacatcgcgtactgcgccgactgcggagcagggcactcgtgtcatagccccgtagca
attgaagcggtcaggtccgaagctaccgacgggatgctgaagattcagttctcggcacaaattggcatagataag
agtgacaatcatgactacacgaagataaggtacgcagacgggcacgccattgagaatgccgtccggtcatctttg
aaggtagccacctccggagactgtttcgtccatggcacaatgggacatttcatactggcaaagtgcccaccgggt
gaattcctgcaggtctcgatccaggacaccagaaacgcggtccgtgcctgcagaatacaatatcatcatgaccct
caaccggtgggtagagaaaatttacaattagaccacactatggaaaagagatcccttgcaccacttatcaacag
accacagcggagaccgtggaggaaatcgacatgcatatgccgccagatacgccggacaggacgttgctatcacag
caatctggcaatgtaaagatcacagtcggaggaaagaaggtgaaatacaactgcacctgtggaaccggaaacgtt
ggcactactaattcggacatgacgatcaacacgtgtctaatagagcagtgccacgtctcagtgacggaccataag
aaatggcagttcaactcacctttcgtcccgagagccgacgaaccggctagaaaaggcaaagtccatatcccattc
ccgttggacaacatcacatgcagagttccaatggcgcgcgaaccaaccgtcatccacggcaaaagagaagtgaca
ctgcaccttcacccagatcatcccacgctcttttcctaccgcacactgggtgaggacccgcagtatcacgaggaa
tgggtgacagcggcgctggaacggaccatacccgtaccagtggacgggatggagtaccactggggaaacaacgac
ccagtgaggctttggtctcaactcaccactgaagggaaaccgcacggctggccgcatcagatcgtacagtactac
tatgggctttacccggccgctacagtatccgcggtcgtcgggatgagcttactggcgttgatatcgatcttcgcg
tcgtgctacatgctggttgcggcccgcagtaagtgcttgaccccttatgctttaacaccaggagctgcagttccg
tggacgctggggatactctgctgcgccccgcgggcgcacgcagctagtgtggcagagactatggcctacttgtgg
gaccaaaaccaagcgttgttctggttggagtttgcggcccctgttgcctgcatcctcatcatcacgtattgcctc
agaaacgtgctgtgttgctgtaagagcctttctttttagtgctactgagcctcggggcaaccgccagagcttac
gaacattcgacagtaatgccgaacgtggtggggttcccgtataaggctcacattgaaaggccaggatatagcccc
ctcactttgcagatgcaggttgttgaaaccagcctcgaaccaacccttaatttggaatacataacctgtgagtac
aagacggtcgtcccgtcgccgtacgtgaagtgctgcggcgcctcagagtgctccactaaagagaagcctgactac
caatgcaaggtttacacaggcgtgtacccgttcatgtggggagggcatattgcttctgcgactcagaaaacacg
caactcagcgaggcgtacgtcgatcgatcggacgtatgcaggcatgatcacgcatctgcttacaaagcccataca
gcatcgctgaaggccaaagtgagggttatgtacggcaacgtaaaccagactgtggatgtttacgtgaacggagac
catgccgtcacgatagggggtactcagttcatattcggccgctgtcatcggcctggaccccgttcgacaacaag
atagtcgtgtacaaagacgaagtgttcaatcaggacttcccgccgtacggatctgggcaaccaggcgcttcggc
gacatccaaagcagaacagtggagagtaacgacctgtacgcgaacacggcactgaagctggcacgcccttcaccc
ggcatggtccatgtaccgtacacacagacaccttcagggttcaaatattggctaaaggaaaaaggacagcccta
aatacgaaggctccttttggctgccaaatcaaaacgaaccctgtcagggccatgaactgcgccgtgggaaacatc
cctgtctccatgaatttgcctgacagcgcctttacccgcattgtcgaggcgccgaccatcattgacctgacttgc
acagtggctacctgtacgcactcctcggatttcggcggcgtcttgacactgacgtacaagaccaacaagaacggg
gactgctctgtacactcgcactctaacgtagctactctacaggaggccacagcaaaagtgaagacagcaggtaag
gtgaccttacacttctccacggcaagcgcatcaccttcttttgtggtgtcgctatgcagtgctagggccacctgt
tcagcgtcgtgtgagcccccgaaagaccacatagtcccatatgcggctagccacagtaacgtagtgtttccagac
atgtcgggcaccgcactatcatgggtgcagaaaatctcgggtggtctgggggccttcgcaatcggcgctatcctg
gtgctggttgtggtcacttgcattgggctccgcagataatctagaccaggccctggatccagatctgctgtgcct
tctagttgccagccatctgttgtttgcccctcccccgtgccttccttgaccctggaaggtgccactcccactgtc
ctttcctaataaaatgaggaaattgcatcgcattgtctgagtaggtgtcattctattctggggggtggggtgggg
caggacagcaagggggaggattgggaagacaatagcaggcatgctggggatgcggtgggctctatgggtacccag
gtgctgaagaattgacccggttcctcctgggccagaaagaagcaggcacatccccttctctgtgacacaccctgt
ccacgcccctggttcttagttccagccccactcataggacactcatagctcaggagggctccgccttcaatccca
cccgctaaagtacttggagcggtctctccctccctcatcagcccaccaaaccaaacctagcctccaagagtggga
agaaattaaagcaagataggctattaagtgcagagggagagaaaatgcctccaacatgtgaggaagtaatgagag
aaatcatagaattttaaggccatgatttaaggccatcatggccttaatcttccgcttcctcgctcactgactcgc
tgcgctcggtcgttcggctgcggcgagcggtatcagctcactcaaaggcggtaatacggttatccacagaatcag
gggataacgcaggaaagaacatgtgagcaaaaggccagcaaaaggccaggaaccgtaaaaaggccgcgttgctgg
cgtttttccataggctccgcccccctgacgagcatcacaaaaatcgacgctcaagtcagaggtggcgaaacccga
caggactataaagataccaggcgtttccccctggaagctccctcgtgcgctctcctgttccgaccctgccgctta
ccggatacctgtccgcctttctcccttcgggaagcgtggcgctttctcatagctcacgctgtaggtatctcagtt
cggtgtaggtcgttcgctccaagctgggctgtgtgcacgaaccccccgttcagcccgaccgctgcgccttatccg
gtaactatcgtcttgagtccaacccggtaagacacgacttatcgccactggcagcagccactggtaacaggatta
gcagagcgaggtatgtaggcggtgctacagagttcttgaagtggtggcctaactacggctacactagaagaacag
tatttggtatctgcgctctgctgaagccagttaccttcggaaaaagagttggtagctcttgatccggcaaacaaa
ccaccgctggtagcggtggtttttttgtttgcaagcagcagattacgcgcagaaaaaaaggatctcaagaagatc
ctttgatcttttctacggggtctgacgctcagtggaacgaaaactcacgttaagggattttggtcatgagattat

Figure 19B continued caaaaaggatcttcacctagatccttttaaattaaaaatgaagttttaaatcaatctaaagtatatatgagtaaa
cttggtctgacagttaccaatgcttaatcagtgaggcacctatctcagcgatctgtctatttcgttcatccatag
ttgcctgactcggggggggggggcgctgaggtctgcctcgtgaagaaggtgttgctgactcataccaggcctgaa
tcgccccatcatccagccagaaagtgagggagccacggttgatgagagctttgttgtaggtggaccagttggtga
ttttgaacttttgctttgccacggaacggtctgcgttgtcgggaagatgcgtgatctgatccttcaactcagcaa
aagttcgatttattcaacaaagccgccgtcccgtcaagtcagcgtaatgctctgccagtgttacaaccaattaac
caattctgattagaaaaactcatcgagcatcaaatgaaactgcaatttattcatatcaggattatcaataccata
tttttgaaaaagccgtttctgtaatgaaggagaaaactcaccgaggcagttccataggatggcaagatcctggta
tcggtctgcgattccgactcgtccaacatcaatacaacctattaatttcccctcgtcaaaaataaggttatcaag
tgagaaatcaccatgagtgacgactgaatccggtgagaatggcaaaagcttatgcatttctttccagacttgttc
aacaggccagccattacgctcgtcatcaaaatcactcgcatcaaccaaaccgttattcattcgtgattgcgcctg
agcgagacgaaatacgcgatcgctgttaaaaggacaattacaaacaggaatcgaatgcaaccggcgcaggaacac
tgccagcgcatcaacaatattttcacctgaatcaggatattcttctaatacctggaatgctgttttcccggggat
cgcagtggtgagtaaccatgcatcatcaggagtacggataaaatgcttgatggtcggaagaggcataaattccgt
cagccagtttagtctgaccatctcatctgtaacatcattggcaacgctacctttgccatgtttcagaaacaactc
tggcgcatcgggcttcccatacaatcgatagattgtcgcacctgattgcccgacattatcgcgagcccatttata
cccatataaatcagcatccatgttggaatttaatcgcggcctcgagcaagacgtttcccgttgaatatggctcat
aacaccccttgtattactgtttatgtaagcagacagttttattgttcatgatgatatatttttatcttgtgcaat
gtaacatcagagattttgagacacaacgtggctttccccccccccccattattgaagcatttatcagggttattg
tctcatgagcggatacatatttgaatgtatttagaaaaataaacaaataggggttccgcgcacatttccccgaaa
agtgccacctgacgtctaagaaaccattattatcatgacattaacctataaaaataggcgtatcacgaggccctt
tcgtc

Figure 20A

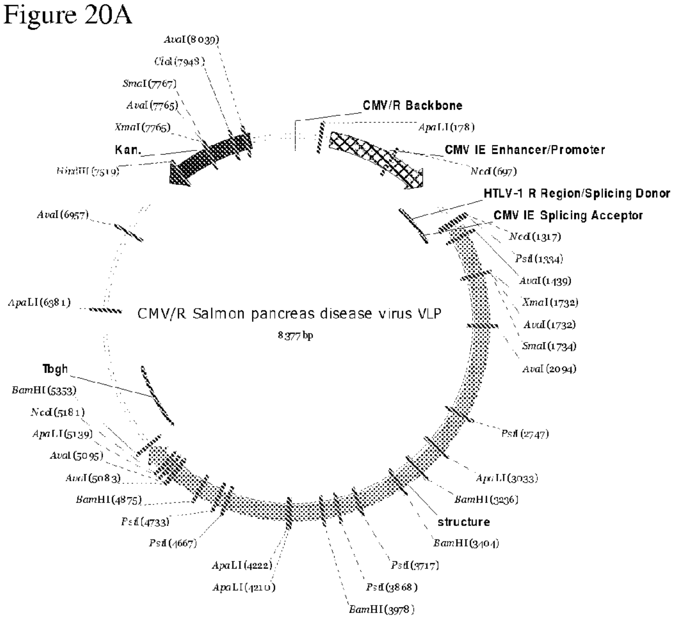

Figure 20B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgcatgtttcccatgcaattcaccaactcagcctatcgccagatggagcccatgt
ttgcaccgggttcccgaggacaagtacagccgtaccggccgcgcactaagcgccgccaggagccgcaagtcggca
acgccgccattactgccctcgcgaaccagatgagtgcgctccagttgcaggtagctggacttgccggccaggcaa
gggtggaccgccgtgggccaagacgtgttcagaagaacaagcagaagaagaagaactcttccaacggagaaaaac
ccaaagagaagaagaagaagcaaaaacaacaggagaagaagggaagcggtggcgaaaaagtcaagaagactagga
accgacccgggaaggaggtaaggatctccgtaaagtgtgcccgacagagcaccttccccgtgtaccacgaaggtg
ctatatccggctacgctgtgctgattggatctcgcgtattcaagccggcacacgtgaagggtaagatcgaccacc
ctgaactggcagacatcaagttccaggtcgccgaggacatggacctcgaagcagctgcgtacccgaagagcatgc
gagaccaagcggctgaaccagcgaccatgatggacagagtgtacaactgggagtatggcactatcagagtggagg
ataatgtcataatcgacgcaagcggtaggggcaagccgggtgacagtggcagggccatcaccgacaactcggga
aggttgttggtattgtcctcggaggaggacccgatggcaggcgcacacgcctctccgtgataggtttcgacaaga
agatgaaggctagggagatcgcctacagtgatgccataccttggacacgcgctccggccctcctgctgctgccta
tggttattgtctgcacctacaattccaacaccttcgattgctccaaaccgtcctgccaggactgctgcattactg
ctgaaccagagaaggccatgaccatgctgaaggacaatctgaacgacccgaactactgggacctactcattgctg
tcaccacctgtggctccgcccggagaaagagggctgtgtctacgtcgcctgccgccttttacgacacacagatcc

Figure 20B continued tcgccgcccacgcagctgcctccccatacagggcgtactgccccgattgtgacggaacagcgtgtatctcgccga
tagccatcgacgaggtggtgagcagtggcagcgaccacgtcctccgcatgcgggttggttctcaatcgggagtga
ccgctaagggtggtgcggcggctgaaacctctctgcgatacctgggaagggacgggaaggttcacgccgcagaca
acacgcgactcgtggtgcgcacgactgcaaagtgcgacgtgctgcaggccactggccactacatcctggccaact
gcccagtggggcagagcctaaccgttgcggccacactggatggcacccggcatcaatgcaccacggttttcgaac
accaagtaacggagaagttcaccagagaacgcagcaagggccaccatctgtccgacatgaccaagaaatgcacca
gattttccactacaccaaaaaagtccgccctctacctcgttgatgtgtatgacgctctgccgatttctgtagaga
ttagcaccgtcgtaacatgcagcgacagccagtgcacagtgagggtgccacctggtaccacagtgaaattcgaca
agaaatgcaagagcgctgactcggcaaccgtcactttcaccagcgactcccagacgtttacgtgtgaggagccag
tcctaacggctgccagtatcacccagggcaagccacacctcagatcggcaatgttgcctagcggaggcaaggaag
tgaaagcaaggatcccgttcccgttcccgccggaaaccgcaacttgcagagtgagtgtagccccactgccgtcga
tcacctacgaggaaagcgatgtcctgctagccggtaccgcaaaataccctgtgctgctaaccacacggaaccttg
gtttccatagcaacgccacatccgaatggatccagggcaagtacctgcgccgcatcccggtcacgcctcaaggga
tcgagctaacatggggaaacaacgcgccgatgcacttttggtcatccgtcaggtacgcatccggggacgctgatg
cgtacccctgggaacttctggtgtaccacaccaagcaccatccagagtacgcgtgggcgtttgtaggagttgcat
gcggcctgctggctatcgcagcgtgcatgtttgcgtgcgcatgcagcagggtgcggtactctctggtcgccaaca
cgttcaactcgaacccaccaccattgaccgcactgactgcagcactgtgttgcataccaggggctcgcgcggacc
aaccctacttggacatcattgcctacttgtggaccaacagcaaagtggccttcgggctacaatttgcggcgcccg
tggcctgtgtgctcatcattacatacgcccttaggcactgcagattgtgctgcaagtctttttttaggggtaagag
ggtggtcagccctgctggtcatccttgcgtatgtacagagctgcaagagctacgaacacaccgtggtggtcccaa
tggatccaagagccccgtcgtacgaagcagtgataaaccggaatgggtatgatccattgaagctgaccatctcag
tgaatttcaccgtcatctcaccaactacggctctggaatattggacctgcgcaggagtccccatcgtcgagccgc
cccatgtggctgctgcacgtcggtgtcctgcccctctgacctctctacgctgcatgcgtttactggcaaagctg
tctccgacgtgcactgcgatgtgcacacaaacgtgtaccccttgttgtggggcgcggctcactgcttctgttcca
ccgagaatacacaggtcagcgctgtggcagccaccgtttctgagttctgtgcccaggactcagagcgtgccgaag
cgttcagcgtacacagcagctcagtcaccgctgaggtcctggtgacgcttggtgaagtggtgacggcagtccacg
tttacgtggacggggtaacatcagccaggggcactgacctcaagatcgtggctggaccaataacaaccgactact
ccccattcgatcgcaaagtagtccgcatcggcgaagaggtctataactatgactggcctccttacggggctggcc
gaccagccacattcggagacattcaagctaggtcaaccaactatgtcaaacccaacgatctgtatggggacatcg
gaattgaagtactgcagccgactaacgaccacgtacatgtggcttacacgtatacgacctctgggttactgcgtt
ggctgcaggacgctccgaaaccactcagtgtcacagcaccgcacggttgtaagatcagtgccaatccgctcctgg
ccctcgattgtggggttggtgccgtccccatgtccatcaacattccggacgcgaagtttacccgcaaattaaagg
atccgaaaccatcggccctgaaatgcgtggtggacagctgcgagtacggggtggactacgggggcgccgccacga
tcacctacgagggccacgaggccgggaagtgcgggattcattccctgacaccaggagtcccccctgagaacatcgg
tggttgaagtggttgctggcgccaataccgtcaaaacgaccttctcctcacccacgcccgaggttgcactcgagg
tagagatctgttcggcaatagtgaagtgcgctggtgagtgcactccaccgaaggaacatgtggtcgcaaccaggc
ctcgccatggcagcgaccctggaggctacatctccgggcccgcaatgcgctgggccggagggattgtagggaccc
tagtggtcctgttccttatccttgccgtcatctactgcgtggtgaagaagtgccgctccaaaagaatccggatag
tcaagagctaatctagaccaggccctggatccagatctgctgtgccttctagttgccagccatctgttgtttgcc
cctcccccgtgccttccttgaccctggaaggtgccactcccactgtcctttcctaataaaatgaggaaattgcat
cgcattgtctgagtaggtgtcattctattctggggggtggggtggggcaggacagcaagggggaggattgggaag
acaatagcaggcatgctggggatgcggtgggctctatgggtacccaggtgctgaagaattgacccggttcctcct
gggccagaaagaagcaggcacatccccttctctgtgacacaccctgtccacgcccctggttcttagttccagccc
cactcataggacactcatagctcaggagggctccgccttcaatcccacccgctaaagtacttggagcggtctctc
cctccctcatcagcccaccaaaccaaacctagcctccaagagtgggaagaaattaaagcaagataggctattaag
tgcagagggagagaaaatgcctccaacatgtgaggaagtaatgagagaaatcatagaattttaaggccatgattt
aaggccatcatggccttaatcttccgcttcctcgctcactgactcgctgcgctcggtcgttcggctgcggcgagc
ggtatcagctcactcaaaggcggtaatacggttatccacagaatcaggggataacgcaggaaagaacatgtgagc
aaaaggccagcaaaaggccaggaaccgtaaaaaggccgcgttgctggcgtttttccataggctccgcccccctga
cgagcatcacaaaaatcgacgctcaagtcagaggtggcgaaacccgacaggactataaagataccaggcgtttcc
ccctggaagctccctcgtgcgctctcctgttccgaccctgccgcttaccggatacctgtccgcctttctcccttc
gggaagcgtggcgctttctcatagctcacgctgtaggtatctcagttcggtgtaggtcgttcgctccaagctggg
ctgtgtgcacgaaccccccgttcagcccgaccgctgcgccttatccggtaactatcgtcttgagtccaacccggt
aagacacgacttatcgccactggcagcagccactggtaacaggattagcagagcgaggtatgtaggcggtgctac
agagttcttgaagtggtggcctaactacggctacactagaagaacagtatttggtatctgcgctctgctgaagcc
agttaccttcggaaaaagagttggtagctcttgatccggcaaacaaaccaccgctggtagcggtggtttttttgt
ttgcaagcagcagattacgcgcagaaaaaaaggatctcaagaagatcctttgatcttttctacggggtctgacgc
tcagtggaacgaaaactcacgttaagggattttggtcatgagattatcaaaaaggatcttcacctagatcctttt
aaattaaaaatgaagttttaaatcaatctaaagtatatatgagtaaacttggtctgacagttaccaatgcttaat
cagtgaggcacctatctcagcgatctgtctatttcgttcatccatagttgcctgactcggggggggggggcgctg
aggtctgcctcgtgaagaaggtgttgctgactcataccaggcctgaatcgccccatcatccagccagaaagtgag

Figure 20B continued ggagccacggttgatgagagctttgttgtaggtggaccagttggtgatttgaacttttgctttgccacggaacg
gtctgcgttgtcgggaagatgcgtgatctgatccttcaactcagcaaaagttcgatttattcaacaaagccgccg
tcccgtcaagtcagcgtaatgctctgccagtgttacaaccaattaaccaattctgattagaaaaactcatcgagc
atcaaatgaaactgcaatttattcatatcaggattatcaataccatatttttgaaaaagccgtttctgtaatgaa
ggagaaaactcaccgaggcagttccataggatggcaagatcctggtatcggtctgcgattccgactcgtccaaca
tcaatacaacctattaatttcccctcgtcaaaaataaggttatcaagtgagaaatcaccatgagtgacgactgaa
tccggtgagaatggcaaaagcttatgcatttctttccagacttgttcaacaggccagccattacgctcgtcatca
aaatcactcgcatcaaccaaaccgttattcattcgtgattgcgcctgagcgagacgaaatacgcgatcgctgtta
aaaggacaattacaaacaggaatcgaatgcaaccggcgcaggaacactgccagcgcatcaacaatattttcacct
gaatcaggatattcttctaatacctggaatgctgttttcccggggatcgcagtggtgagtaaccatgcatcatca
ggagtacggataaaatgcttgatggtcggaagaggcataaattccgtcagccagtttagtctgaccatctcatct
gtaacatcattggcaacgctacctttgccatgtttcagaaacaactctggcgcatcgggcttcccatacaatcga
tagattgtcgcacctgattgcccgacattatcgcgagcccatttatacccatataaatcagcatccatgttggaa
tttaatcgcggcctcgagcaagacgtttcccgttgaatatggctcataacaccccttgtattactgtttatgtaa
gcagacagttttattgttcatgatgatatatttttatcttgtgcaatgtaacatcagagattttgagacacaacg
tggctttccccccccccccattattgaagcatttatcagggttattgtctcatgagcggatacatatttgaatgt
atttagaaaaataaacaaataggggttccgcgcacatttccccgaaaagtgccacctgacgtctaagaaaccatt
attatcatgacattaacctataaaaataggcgtatcacgaggccctttcgtc

Figure 21A

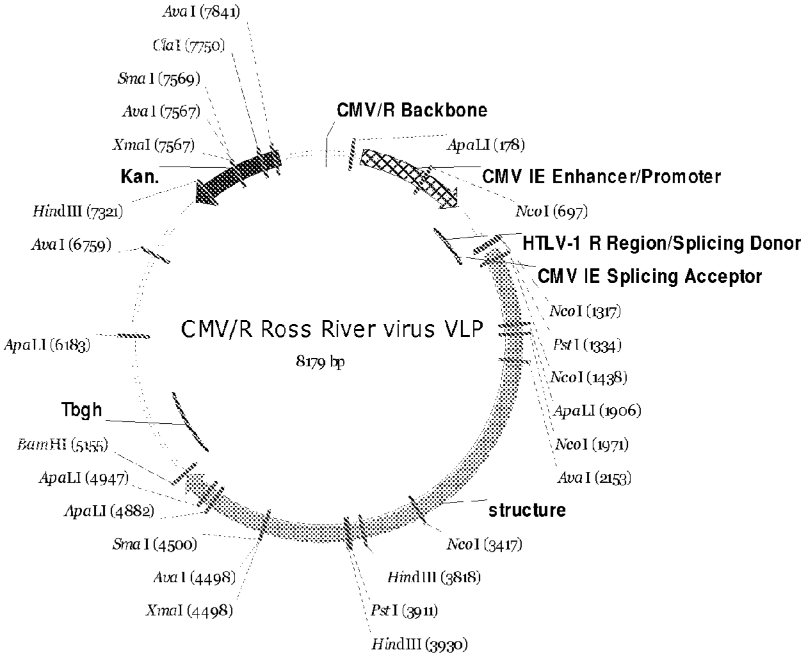

Figure 21B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgcatgaattacataccaacccagacttttacggacgccgttggcggcctcgcc
cggcgttccgtccatggcaggtgccgatgcagccgacacctactatggttacacccatgctgcaagcaccggacc
tacaggctcaacagatgcaacaactgatcagcgcagtctctgcactaaccaccaaacagaatgtaaaagcaccaa
aagggcaacggaaacagaaacagcagaaaccaaaggaaaagaaggaaaaacagaagaaaaagccgacgcnnaaga
agaagcagcagcagaaaccaaaaccacaggctaagaagaagaaaccagggagaagagaaagaatgtgcatgaaga
tcgagaatgactgcatattcgaggtcaaactggacggcaaggttaccggctatgcgtgcctagtcggagataagg
tcatgaagccggctcacgttaaaggcacaattgataacccagaccttgcgaagttgacttacaagaaatccagta
agtatgacctcgaatgcgcccagatcccagtgcacatgaagtccgacgcctccaagtacacacatgaaaagcccg
aaggtcattacaattggcaccatggagcagtgcagtacagcgnnggaaggtttaccatccccacaggcgccggca
aaccaggagatagcggtaggcctatttttgacaacaaagggcgagtngtggccatcgtgttaggcggggccaacg
aaggtgcccgcactgcgctgtctgtggtgacgtggacaaaagacatggtcactcgggtaacgccagaaggaaccg
aagagtggtctgccgcgctgatgatgtgtatccttgccaacacctctttcccatgctcgtcacctccctgctacc
cctgctgctacgaaaaacagccagaacagacactgcggatgctggaagacaacgtgaatagacctgggtactatg
agttactggaagcgtccatgacatgcagaaacagatcacgccaccgccgcagtgtaatagagcacttcaatgtgt

Figure 21B continued ataaggctactagaccgtacttagcnnactgcgctgactgcggggacgggtacttctgctatagcccggttgcta
tcgagaagatccgagatgaggcgtctgatggcatgctcaagatccaagtctccgcccaaataggtctggacaagg
caggtacccacgcccacacgaagatgcgatatatggctggtcatgatgttcaggaatctaagagagattccttga
gggtgtatacgtccgcagcgtgctctatacatgggacgatgggacacttcatcgtcgcacactgtccaccaggcg
actacctcaaggnttcgttcgaggacgcaaattcacacgtgaaggcatgtaaggtccaatacaagcacgacccat
tgccggtgggtagagagaagtttgtggttagaccacactttggcgtagagctgccatgcacctcataccagctga
caacggctcccaccgacgaggagattgacatgcatacaccgccagatataccggatcgcaccctgctatcacaga
cggcgggcaacgtcaaaataacagcaggcggcaggactatcaggtacaattgtacctgcggccgtgacaacgtag
gcactaccagtactgacaagaccatcaacacatgcaagatagaccaatgccatgctgccgttaccagccatgaca
aatggnaatttacctctccatttgttcccagggctgatcagacagccaggaaaggcaaagtgcatgttccattcc
ctttgactaacgtcacctgccgagtgccgttggcacgagcgccggatgtcacctatggtaagaaggaggtgaccc
taagattacacccagatcatccgacgcncttctcctataggagtttaggagccgtaccgcacccgtacgaggaat
gggttgacaagttctctgagcgcatcatcccagtgacggaagaagggattgagtaccagtggggtaacaacccgc
cggtccgcctgtgggcgcaactgacgactgagggtaaaccccatggctggccacatgaaatcattcagtactatt
atggactataccccgccgccactattgccgcagtatccggggcgagtctgatggccctcctaactctagcggcca
catgctgcatgctggccaccgcgaggagaaagtgcctaacaccgtacgctttgacgccaggagcggtggtaccgt
tgacattggggctgcttnnntgcgcaccgagggcgaacgcagcatcatttgctgagactatggcctatctgtggg
acgagaacaaaccctcttttggatggaatnnnnnnnnnnnnnnnnnngcgcttgctttgctggcatgctgtatca
aaagcctgatctgctgttgtaagccatttcttttttagtgttactgagcctgggagcctccgcaaaagcttatg
agcacacagccacaattccgaacgtggtggggttcccgtataaggctcacattgaaaggaatnnnttctcgccca
tgactctgcagcttgaagtggtggannncaagcttggaacccacacttaacctggagtacattacctgcgaataca
agacggtggtcccttcgccatttatcaaatgttgcggaacatcagaatgctcatctaaagagcagccagactacc
aatgcaaggtgtacacgggtgtataccctttcatgtggcgtggagcttactgtttctgcgactccgagaacacgc
agcttagcgaggcctatgtcgacaggtcagacgtttgcaaacatgatcatgcattggcctacaaggcacacacgg
cctctctaaaagcaacaatcaggatcagctacggcaccatcaaccagaccaccgaggccttcgtcaatcgagaac
acgcggtcaacgtgggcggaagcaagttcatctttggaccgatctcaacagcttggtcaccgttcgacaataaaa
ttgtcgtgtataaagatgatgtctacaaccaggacttcccaccctacggatcaggccagccgggnagattcggag
acatccagagcaggacagtggagagcaaagacttgtatgctaatacggccctaaaactctcaagaccatcacccg
gggttgtgcatgtgccatacacgcagacaccatccggatttaagtattggctgaaggagaaaggatcttcattga
atacaaaggcccctttggctgcaagataaagaccaatccagtcagagctatggattgtgcagttggcagtatac
ctgtgtcgatggacatacctgacagtgcattcacacgagtggtagatgccccggctgtaacagacctgagctgcc
aggtagctgtctgtacacactcctccgatttcggannngttgccacattgtcttacaagacggacaaacccggca
agtgcgccgttcactcacattccaacgtcgcaacgttgcaagaggcgacggtggatgtcaaggaggatggcaagg
tcacagtgcacttttctnnnnngtccgcctccccggcattcaaagtgtccgtctgtgacgcaaaaacaacgtgca
cggcggcgtgcgagcctccgaaagaccacatcgtcccttatggggcgagccataacaaccaggtctttccggaca
tgtcaggaactgcgatgacgtgggtacagaggatggccagtgggttaggtgggctggccctcatcgcggtggttg
tgctggtcttggtaacctgcataacaatgcgtcggtaatctagaccaggccctggatccagatctgctgtgcctt
ctagttgccagccatctgttgtttgcccctcccccgtgccttccttgaccctggaaggtgccactcccactgtcc
tttcctaataaaatgaggaaattgcatcgcattgtctgagtaggtgtcattctattctggggggtggggtggggc
aggacagcaaggggggaggattgggaagacaatagcaggcatgctggggatgcggtgggctctatgggtacccagg
tgctgaagaattgacccggttcctcctgggccagaaagaagcaggcacatccccttctctgtgacacaccctgtc
cacgcccctggttcttagttccagccccactcataggacactcatagctcaggagggctccgccttcaatcccac
ccgctaaagtacttggagcggtctctccctccctcatcagcccaccaaaccaaacctagcctccaagagtgggaa
gaaattaaagcaagataggctattaagtgcagagggagagaaaatgcctccaacatgtgaggaagtaatgagaga
aatcatagaattttaaggccatgatttaaggccatcatggccttaatcttccgcttcctcgctcactgactcgct
gcgctcggtcgttcggctgcggcgagcggtatcagctcactcaaaggcggtaatacggttatccacagaatcagg
ggataacgcaggaaagaacatgtgagcaaaaggccagcaaaaggccaggaaccgtaaaaaggccgcgttgctggc
gtttttccataggctccgcccccctgacgagcatcacaaaaatcgacgctcaagtcagaggtggcgaaacccgac
aggactataaagataccaggcgtttccccctggaagctccctcgtgcgctctcctgttccgaccctgccgcttac
cggatacctgtccgcctttctcccttcgggaagcgtggcgctttctcatagctcacgctgtaggtatctcagttc
ggtgtaggtcgttcgctccaagctgggctgtgtgcacgaaccccccgttcagcccgaccgctgcgccttatccgg
taactatcgtcttgagtccaacccggtaagacacgacttatcgccactggcagcagccactggtaacaggattag
cagagcgaggtatgtaggcggtgctacagagttcttgaagtggtggcctaactacggctacactagaagaacagt
atttggtatctgcgctctgctgaagccagttaccttcggaaaaagagttggtagctcttgatccggcaaacaaac
caccgctggtagcggtggtttttttgtttgcaagcagcagattacgcgcagaaaaaaaggatctcaagaagatcc
tttgatcttttctacggggtctgacgctcagtggaacgaaaactcacgttaagggattttggtcatgagattatc
aaaaaggatcttcacctagatccttttaaattaaaaatgaagttttaaatcaatctaaagtatatatgagtaaac
ttggtctgacagttaccaatgcttaatcagtgaggcacctatctcagcgatctgtctatttcgttcatccatagt
tgcctgactcggggggggggggcgctgaggtctgcctcgtgaagaaggtgttgctgactcataccaggcctgaat
cgccccatcatccagccagaaagtgagggagccacggttgatgagagctttgttgtaggtggaccagttggtgat
tttgaacttttgctttgccacggaacggtctgcgttgtcgggaagatgcgtgatctgatccttcaactcagcaaa

Figure 21B continued agttcgatttattcaacaaagccgccgtcccgtcaagtcagcgtaatgctctgccagtgttacaaccaattaacc
aattctgattagaaaaactcatcgagcatcaaatgaaactgcaatttattcatatcaggattatcaataccatat
ttttgaaaaagccgtttctgtaatgaaggagaaaactcaccgaggcagttccataggatggcaagatcctggtat
cggtctgcgattccgactcgtccaacatcaatacaacctattaatttcccctcgtcaaaaataaggttatcaagt
gagaaatcaccatgagtgacgactgaatccggtgagaatggcaaaagcttatgcatttctttccagacttgttca
acaggccagccattacgctcgtcatcaaaatcactcgcatcaaccaaaccgttattcattcgtgattgcgcctga
gcgagacgaaatacgcgatcgctgttaaaaggacaattacaaacaggaatcgaatgcaaccggcgcaggaacact
gccagcgcatcaacaatattttcacctgaatcaggatattcttctaatacctggaatgctgttttcccggggatc
gcagtggtgagtaaccatgcatcatcaggagtacggataaaatgcttgatggtcggaagaggcataaattccgtc
agccagtttagtctgaccatctcatctgtaacatcattggcaacgctacctttgccatgtttcagaaacaactct
ggcgcatcgggcttcccatacaatcgatagattgtcgcacctgattgcccgacattatcgcgagcccatttatac
ccatataaatcagcatccatgttggaatttaatcgcggcctcgagcaagacgtttcccgttgaatatggctcata
acaccccttgtattactgtttatgtaagcagacagttttattgttcatgatgatatatttttatcttgtgcaatg
taacatcagagatttgagacacaacgtggctttcccccccccccccattattgaagcatttatcagggttattgt
ctcatgagcggatacatatttgaatgtatttagaaaaataaacaaataggggttccgcgcacatttccccgaaaa
gtgccacctgacgtctaagaaaccattattatcatgacattaacctataaaaataggcgtatcacgaggcccttt
cgtc

Figure 22A

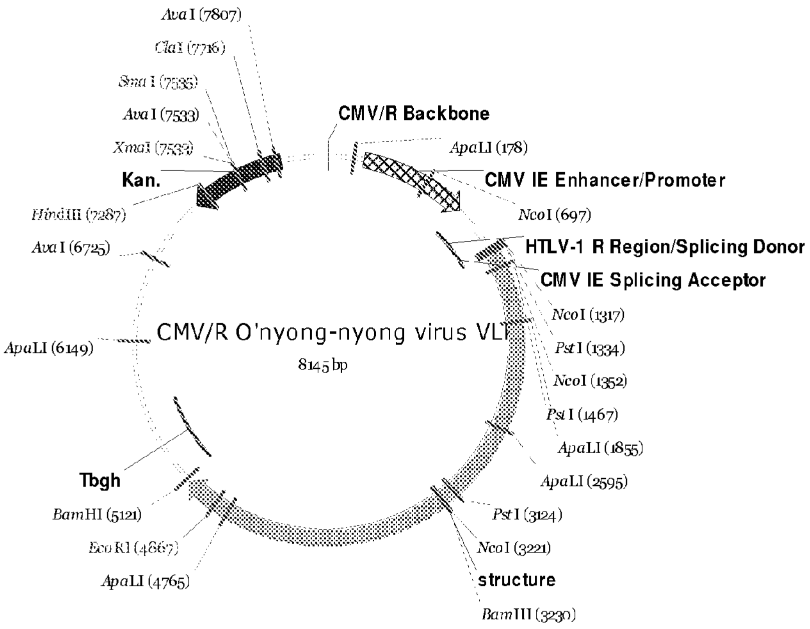

Figure 22B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacca
ccatggagttcataccagcacaaacttactacaatagaagataccagcctagaccctggactcaacgccctacta
tccaggtgatcaggccaaaaccacgccgaagaaggcctgcaggacaactcgcacaactgatatccgcagtcagca
gactagcactgcgtacagttccccagaaaccacgccggacccgaaaaattaagaagcaaaagcaagtaaagcaag
aacaacagagtactacgaaccagaagaaaaggcgccgaaacaaaagcagacccaaaagaaaaagagaccaggac
gaagggaaaggatgtgcatgaagattgaaaatgactgcatcttcgaagtcagacatgaaggaaaagtaacggggt
atgcatgcctagtaggtgataaggtaatgaaaccagcacacgtgaaaggaactattgacaacgcagacctagcga
agttggcgttcaaaagatcatccaaatatgatctagagtgcgcacagataccagtgcacatgaaatcggacgcct
caaagttcacccatgaaaaaccagaaggctattacaactggcatcacggagcagtacagtattctggagggaggt
tcacgatccctacaggcgcaggaaagcctggggacagcggaagaccaatctttgacaacaaggggcgtgtcgtgg
ctattgttctaggcggagcaaacgaaggaaccaggacagcactatctgtagtgacttggaataaagacatagtca
caaaaatcacaccagaggggtcagttgaatggagccttgccctccctgtcatgtgcctgttggcaaatacaacct
tcccatgttcccaaccgccttgcgcgccgtgctgctacgaaaagaaaccggaagaaaccttgagaatgctggagg
acaacgtcatgcaaccaggatattaccagttactcgattcagcattggcctgctcacaacgtcgtcaaaaacgta
atgcaagagaaaacttcaatgtctacaaagtcactaggccgtacttagcccactgtcctgactgcggggagggac

Figure 22B continued actcatgccacagcccaatagcattagaacggatcagaagtgaggcaacagatggtaccttgaaaatccagctat
ctctgcaaatcggaataaagacagacgacagccacgattggacgaagctacggtatatggatagccatacacctg
tggatgcagaccgatccgggttgtttgtcagaacgtcagcaccgtgcaccatcacgggaacgatgggacatttca
tactagcacgctgtccgaaaggagagacgctgacggtaggatttgtagacagtagaaggatcagtcacacgtgca
tgcacccgttccgccacgagccaccgctgatagggagagagaagtttcactcccgcccgcagcatggcaaagaac
taccttgcagtacatacgtccataccacagcggcaactgctgaggaaatagaagtgcatatgccgccagataccc
ctgactacacgctgatgacacagcaagcgggaaacgttaagatcacagttgacggccagacggtacgatacaagt
gcaaatgtgacggctccaatgaaggattaataaccgctgacaaagtcataaataactgcaaagtagaccaatgcc
acacagcggttacaaaccacaagaaatggcaatacaattcaccgctgaccccgcggaactccgaacaaggagata
gaaaaggtaagatccatatcccatttccactggtgaacacaacctgcagggtaccaaaagcaagaaatccgactg
tcacatacggtaaaaacagagtcactctgctgttacatccagaccacccaacactcctttcgtaccgcgccatgg
gaaggatcccggattaccatgaagagtggataacaaacaagaaggaaataagtatcacagtaccagcagaaggct
tagaggttacgtggggtaataatgacccatacaaatattggccccaactgtctacaaatggtactgcgcacgggc
acccacatgaaataatcctctattactatgagctgtacccaactaccacaattgctgtactagctgctgcttcta
tcgtaataacatctttggtaggtctatcattaggcatgtgcatatgcgcgagacgcaggtgcatcacgccatatg
agctgactccaggagctaccatcccattcctcctaggtgtactatgctgtgccaggactgcaaaagcagcatcgt
actacgaagctgcaacatacctctggaatgagcaacaaccattattttggttacagcttctaatccctctgtcag
ctgcaattgttgtgtgtaattgcctaaaactttaccatgctgctgcaaaacattgactttttagccgtcatga
gcatcggtgcccgcactgtgaccgcgtacgagcacgcaacagtgatcccgaacacggtgggagtaccgtgtaaga
ctcttgttagcagaccagggtacagccctatggtcttagaaatggagctacagtcggtcactctggaaccagcat
tatccttggattacattacgtgtgagtataaaacaatcacaccgtccccgtacgtaaaatgctgtggtacagctg
aatgtaaggccaagaacctgccagattataactgcaaagtattcacaggcgtctacccatttatgtggggaggag
catactgcttctgtgacgcagagaacacacagctcagcgaggcacacgttgagaaatcagaatcatgcaaaactg
agtttgcatcagcctacagagcccacacagcttcagtatcagctaaactacgtgtcttttaccaagggaataata
tcaccgtgtctgcatacgccaatggtgatcatgcagttacggtggaagacgcgaagtttgtcatcggtccactat
cgtccgcctggtcaccatttgataataagatcgtggtgtacaaaggcgaagtctacaatatggactatccacctt
tcggcgcagggaggccaggacagttcggtgacatccagagccgcacgccagacagcaaggacgtctatgcgaata
cgcagttaatactgcaaagaccagcggcaggagcaatacacgtgccttactcccaggcaccttcgggctttaagt
actggctcaaggaaaaggggcatcattgcagcatactgcaccatttggctgtcagatagcaacaaacccggtaa
gagcagtgaactgtgcagtgggcaacataccagtctccattgacatcccagatgcagctttcaccagggtcactg
acgctccttccatcacagacatgtcctgcgaagtagcttcgtgtacccattcatctgattttggaggtgccgcag
tcataaagtacacagctagtaaaaaggaaaatgcgccgtgcactctgtaacaaatgcggtcactatccgcgaac
ctaacgtagatgtcaagggaacagcacaattgcaaattgccttctcgaccgcactagctagtgcggaattcaagg
tgcagatctgctccacactggtacactgctcagcgacgtgccatcctcctaaagaccatatagtcaattacccgt
cacctcacaccacactaggagtgcaggacatttcaacgacagctatgtcttgggtccagaagattacaggaggag
tgggactcgtggttgctatagctgctttgatcttaattatagttctctgcgtatcatttagcagacactaagcgg
ccgctctagaccaggccctggatccagatctgctgtgccttctagttgccagccatctgttgtttgcccctcccc
cgtgccttccttgaccctggaaggtgccactcccactgtcctttcctaataaaatgaggaaattgcatcgcattg
tctgagtaggtgtcattctattctggggggtggggtggggcaggacagcaagggggaggattgggaagacaatag
caggcatgctggggatgcggtgggctctatgggtacccaggtgctgaagaattgacccggttcctcctgggccag
aaagaagcaggcacatccccttctctgtgacacaccctgtccacgcccctggttcttagttccagccccactcat
aggacactcatagctcaggagggctccgccttcaatcccacccgctaaagtacttggagcggtctctccctccct
catcagcccaccaaaccaaacctagcctccaagagtgggaagaaattaaagcaagataggctattaagtgcagag
ggagagaaaatgcctccaacatgtgaggaagtaatgagagaaatcatagaattttaaggccatgatttaaggcca
tcatggccttaatcttccgcttcctcgctcactgactcgctgcgctcggtcgttcggctgcggcgagcggtatca
gctcactcaaaggcggtaatacggttatccacagaatcaggggataacgcaggaaagaacatgtgagcaaaaggc
cagcaaaaggccaggaaccgtaaaaaggccgcgttgctggcgtttttccataggctccgcccccctgacgagcat
cacaaaaatcgacgctcaagtcagaggtggcgaaacccgacaggactataaagataccaggcgtttccccctgga
agctccctcgtgcgctctcctgttccgaccctgccgcttaccggatacctgtccgcctttctcccttcgggaagc
gtggcgctttctcatagctcacgctgtaggtatctcagttcggtgtaggtcgttcgctccaagctgggctgtgtg
cacgaaccccccgttcagcccgaccgctgcgccttatccggtaactatcgtcttgagtccaacccggtaagacac
gacttatcgccactggcagcagccactggtaacaggattagcagagcgaggtatgtaggcggtgctacagagttc
ttgaagtggtggcctaactacggctacactagaagaacagtatttggtatctgcgctctgctgaagccagttacc
ttcggaaaaagagttggtagctcttgatccggcaaacaaaccaccgctggtagcggtggtttttttgtttgcaag
cagcagattacgcgcagaaaaaaaggatctcaagaagatcctttgatcttttctacggggtctgacgctcagtgg
aacgaaaactcacgttaagggattttggtcatgagattatcaaaaaggatcttcacctagatccttttaaattaa
aaatgaagttttaaatcaatctaaagtatatatgagtaaacttggtctgacagttaccaatgcttaatcagtgag
gcacctatctcagcgatctgtctatttcgttcatccatagttgcctgactcggggggggggggcgctgaggtctg
cctcgtgaagaaggtgttgctgactcataccaggcctgaatcgccccatcatccagccagaaagtgagggagcca
cggttgatgagagctttgttgtaggtggaccagttggtgattttgaacttttgctttgccacggaacggtctgcg
ttgtcgggaagatgcgtgatctgatccttcaactcagcaaaagttcgatttattcaacaaagccgccgtcccgtc

Figure 22B continued aagtcagcgtaatgctctgccagtgttacaaccaattaaccaattctgattagaaaaactcatcgagcatcaaat
gaaactgcaatttattcatatcaggattatcaataccatatttttgaaaaagccgtttctgtaatgaaggagaaa
actcaccgaggcagttccataggatggcaagatcctggtatcggtctgcgattccgactcgtccaacatcaatac
aacctattaatttcccctcgtcaaaaataaggttatcaagtgagaaatcaccatgagtgacgactgaatccggtg
agaatggcaaaagcttatgcatttctttccagacttgttcaacaggccagccattacgctcgtcatcaaaatcac
tcgcatcaaccaaaccgttattcattcgtgattgcgcctgagcgagacgaaatacgcgatcgctgttaaaaggac
aattacaaacaggaatcgaatgcaaccggcgcaggaacactgccagcgcatcaacaatattttcacctgaatcag
gatattcttctaatacctggaatgctgttttcccggggatcgcagtggtgagtaaccatgcatcatcaggagtac
ggataaaatgcttgatggtcggaagaggcataaattccgtcagccagtttagtctgaccatctcatctgtaacat
cattggcaacgctacctttgccatgtttcagaaacaactctggcgcatcgggcttcccatacaatcgatagattg
tcgcacctgattgcccgacattatcgcgagcccatttatacccatataaatcagcatccatgttggaatttaatc
gcggcctcgagcaagacgtttcccgttgaatatggctcataacaccccttgtattactgtttatgtaagcagaca
gttttattgttcatgatgatatatttttatcttgtgcaatgtaacatcagagattttgagacacaacgtggcttt
cccccccccccccattattgaagcatttatcagggttattgtctcatgagcggatacatatttgaatgtatttaga
aaaataaacaaataggggttccgcgcacatttccccgaaaagtgccacctgacgtctaagaaaccattattatca
tgacattaacctataaaaataggcgtatcacgaggccctttcgtc

Figure 23A

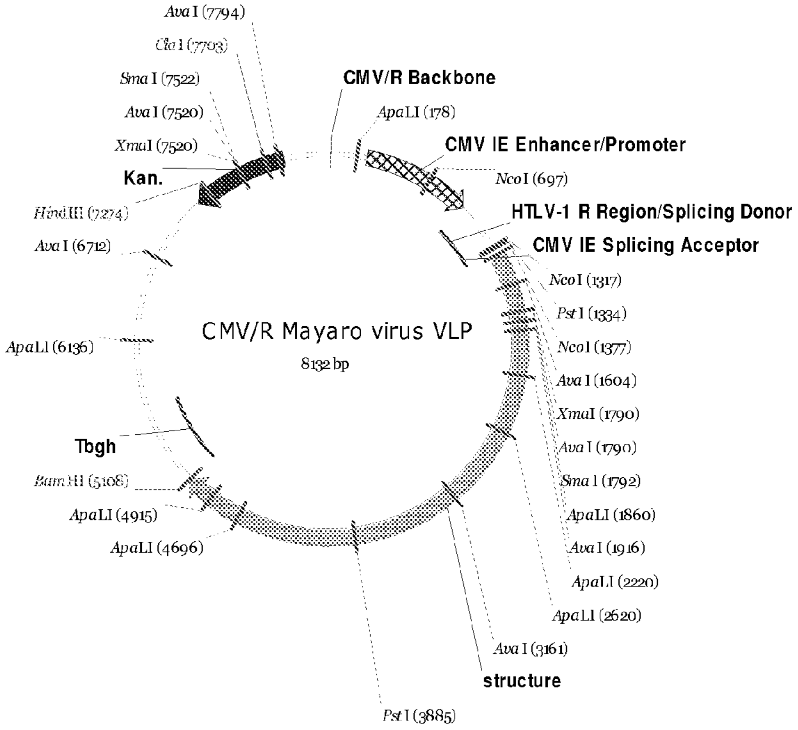

Figure 23B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatggacttcctaccaactcaagtgttctatggcagacgctggagacca
cgaatgccgccacgcccttggagaccacgcatgcctacaatgcagagaccagaccaacaggcccgacaaatgcag
caattgattgcagcggttagcacgcttgccctgaggcagaatgcagccgcccctcagcgtggaaagaagaagcag
ccacgcagaaagaaaccaaaaccgcagcccgagaaaccaaagaagcaagaacagaagccgaagcaaaagaaggcc
cctaaacgaaagccagggagaagagaacgcatgtgcatgaagattgagcatgattgcatcttcgaggttaagcac
gaaggtaaagtcacgggttacgcctgccttgtcggtgacaaggtaatgaagccagcacacgttcccggggtgata
gacaatgcagatcttgcacgcctgtcgtacaagaaatccagtaagtacgatctggaatgtgcacaaatacccgtg
gctatgaagtcagatgcttcgaagtacacccatgagaaacccgagggtcattacaactggcactacggcgccgtc
cagtacacgggaggaagattcacggtgcccacaggagtgggtaagcctggcgacagcggtcggcccatctttgac
aacaaagggccggttgtcgcaatagtgctgggaggagccaacgaaggtaccagaaccgccctttccgttgtgaca
tggaataaagacatggtcacgaagattacacctgaaggcactgtggagtgggcagcctcgacagtgacagccatg

Figure 23B continued tgtcttttgacaaatatatccttcccatgtttccaaccgagctgtgcaccgtgctgctatgaaaaggggcctgag
ccgacgctgaggatgctggaggagaacgtaaattcagaaggatattacgacctgctgcacgctgccgtgtactgt
agaaacagttcaaggtcgaagagaagcactgcaaatcattttaatgcgtataagttgacccgtccatatgtggct
tactgcgcagactgcggtatgggtcattcttgccacagcccagccatgatcgaaaatattcaggcggatgcaaca
gatggcacgctaaaaattcagtttgcttcccaaattggcctgaccaaaacggacacgcacgatcacacaaagatt
agatatgctgaaggacacgacattgcagaggctgccagatcaacccttaaggtacacagtagcagtgagtgcacg
gtaaccggcacaatgggacactttatcctggccaaatgtccacctggcgaacgaatcagtgtctcatttgttgat
tcgaaaaacgaacaccggacctgccggatagcctaccaccatgaacagaggttaatagggcgagaaagattcacg
gtgcgaccgcatcatggaattgagctaccttgcaccacttatcaattgactaccgccgaaacctctgaagaaatt
gatatgcacatgccgccggacattccggatagaactatcctttcccaacaatcaggaaatgttaagataacggtg
aatcgacgaaccgtcaggtacagctcttcttgcggttcccaagccgtcgggacaacaaccacagacaagaccatt
aatagctgtaccgttgacaaatgtcaggcttacgtcacgagccacacaaaatggcaattcaattcaccttttgtc
cccacgtcggatgcaagcagagcgcaagggcaaagtgcatatcccctttccccttattaacaccacctgccgtgta
ccgctggctcccgaggcccttgttaggagcggtaaacgcgaagctacactttcattgcaccctatccaccccaca
ttgctaagttacagaacatttggagcggagcgggtctttgacgagcagtggatcaccgcccagacggaggtaacg
atcccggtacctgtggagggagtggagtaccagtggggcaaccataaacctcaacgttttgtggtcgcactgacg
actgaaggcaaagcacatggatggcctcatgaaattattgaatactactacggactgcatcctacgacaaccatt
gtcgtggtgattcgtgtctcagtggtggtgcttctgtcattcgccgcctcggtctacatgtgcgtggtagcacga
accaaatgtctgacaccatatgcactcacgccgggagctgttgttcctgttaccattggggtgctgtgttgcgca
ccgaaagcacatgcagccagtttcgcagaaggtatggcctatctgtgggataacaatcagtcgatgttctggatg
gagctgaccggaccattggccctccttattctggctacatgctgcgcccgatcactgctttcctgctgcaagggg
tctttttagtcgcaatgagcatcgggagtgccgttgccagtgcttacgagcacacggcaattattccgaaccaa
gtgggattcccgtataaggctcatgttgcgcgtgaaggttacagtcctttgaccctgcagatgcaggtgatagag
accagccttgagccaacactcaacctggagtatatcacttgcgattacaaaacaaaagttccatcaccatacgta
aagtgctgcggcacggcagaatgccgcacacaggacaagcctgagtacaaatgtgcagtgttcacaggtgtgtat
cctttatgtggggaggtgcatactgtttttgtgattcggagaacacacagatgagcgaagcctacgtggagcgc
gctgacgtgtgtaaacacgaccacgcagctgcctaccgtgcccacaccgcatcccttagagcaaaaattaaggtg
acatacggtactgtgaaccagacagttgaggcgtatgtgaacggtgaccatgccgtaacgattgccggaacaaaa
tttatttttgggccagtgtcaacgccttggacaccgttcgatacaaaaattctggtttacaaaggggagttatac
aatcaggacttcccacggtatggtgccggcagcctggaagatttggggacattcagagccggacgctggatagt
cgagacctatatgccaacacgggcctcaagctggcacgaccggcagccggcaacattcacgtcccctataccccag
actccatctggctttaaaacatggcaaaaagacagggactcaccgcttaacgccaaggcgccttttggatgcata
atccagacaaatccggtccgagccatgaactgcgccgtcggcaacatacccgtttcgatggatatcgccgacagc
gccttcacaagattgaccgacgcgcctgtaatctctgagttgacgtgcactgtgtctacatgcacgcactcatcg
gattttggcgggatcgctgtactttcctacaaggtggaaaaatcaggcaggtgcgacatccattcacattcaaac
gtcgcggtactccaggaagtttccatcgagacagaaggtcgatcagtgatccacttctcaaccgcatcagcctcc
ccttccttcgtagtttctgtttgtagttcgcgtgctacgtgcacagcgaaatgtgaaccaccgaaagaccacgtt
gttacatatccagcaaatcataacggggtaactttgccagacttatctagcactgccatgacgtgggcacaacat
cttgccggcggagttgggttgctgatagctctggccgtgctaattctggtaatagttacttgtgtgactttgaga
aggtaaggatccagatctgctgtgccttctagttgccagccatctgttgtttgcccctcccccgtgccttccttg
accctggaaggtgccactcccactgtcctttcctaataaaatgaggaaattgcatcgcattgtctgagtaggtgt
cattctattctggggggtggggtggggcaggacagcaagggggaggattgggaagacaatagcaggcatgctggg
gatgcggtgggctctatgggtacccaggtgctgaagaattgacccggttcctcctgggccagaaagaagcaggca
catccccttctctgtgacacaccctgtccacgcccctggttcttagttccagccccactcataggacactcatag
ctcaggagggctccgccttcaatcccacccgctaaagtacttggagcggtctctccctccctcatcagcccacca
aaccaaacctagcctccaagagtgggaagaaattaaagcaagataggctattaagtgcagagggagagaaaatgc
ctccaacatgtgaggaagtaatgagagaaatcatagaattttaaggccatgatttaaggccatcatggccttaat
cttccgcttcctcgctcactgactcgctgcgctcggtcgttcggctgcggcgagcggtatcagctcactcaaagg
cggtaatacggttatccacagaatcaggggataacgcaggaaagaacatgtgagcaaaaggccagcaaaaggcca
ggaaccgtaaaaaggccgcgttgctggcgtttttccataggctccgcccccctgacgagcatcacaaaaatcgac
gctcaagtcagaggtggcgaaacccgacaggactataaagataccaggcgtttccccctggaagctccctcgtgc
gctctcctgttccgaccctgccgcttaccggatacctgtccgcctttctcccttcgggaagcgtggcgctttctc
atagctcacgctgtaggtatctcagttcggtgtaggtcgttcgctccaagctgggctgtgtgcacgaaccccccg
ttcagcccgaccgctgcgccttatccggtaactatcgtcttgagtccaacccggtaagacacgacttatcgccac
tggcagcagccactggtaacaggattagcagagcgaggtatgtaggcggtgctacagagttcttgaagtggtggc
ctaactacggctacactagaagaacagtatttggtatctgcgctctgctgaagccagttaccttcggaaaaagag
ttggtagctcttgatccggcaaacaaaccaccgctggtagcggtggtttttttgtttgcaagcagcagattacgc
gcagaaaaaaaggatctcaagaagatcctttgatcttttctacggggtctgacgctcagtggaacgaaaactcac
gttaagggattttggtcatgagattatcaaaaaggatcttcacctagatccttttaaattaaaaatgaagtttta
aatcaatctaaagtatatatgagtaaacttggtctgacagttaccaatgcttaatcagtgaggcacctatctcag
cgatctgtctatttcgttcatccatagttgcctgactcggggggggggggcgctgaggtctgcctcgtgaagaag

Figure 23B continued gtgttgctgactcataccaggcctgaatcgccccatcatccagccagaaagtgagggagccacggttgatgagag
ctttgttgtaggtggaccagttggtgattttgaacttttgctttgccacggaacggtctgcgttgtcgggaagat
gcgtgatctgatccttcaactcagcaaaagttcgatttattcaacaaagccgccgtcccgtcaagtcagcgtaat
gctctgccagtgttacaaccaattaaccaattctgattagaaaaactcatcgagcatcaaatgaaactgcaattt
attcatatcaggattatcaataccatatttttgaaaaagccgtttctgtaatgaaggagaaaactcaccgaggca
gttccataggatggcaagatcctggtatcggtctgcgattccgactcgtccaacatcaatacaacctattaattt
cccctcgtcaaaaataaggttatcaagtgagaaatcaccatgagtgacgactgaatccggtgagaatggcaaaag
cttatgcatttctttccagacttgttcaacaggccagccattacgctcgtcatcaaaatcactcgcatcaaccaa
accgttattcattcgtgattgcgcctgagcgagacgaaatacgcgatcgctgttaaaaggacaattacaaacagg
aatcgaatgcaaccggcgcaggaacactgccagcgcatcaacaatattttcacctgaatcaggatattcttctaa
tacctggaatgctgttttcccggggatcgcagtggtgagtaaccatgcatcatcaggagtacggataaaatgctt
gatggtcggaagaggcataaattccgtcagccagtttagtctgaccatctcatctgtaacatcattggcaacgct
acctttgccatgtttcagaaacaactctggcgcatcgggcttcccatacaatcgatagattgtcgcacctgattg
cccgacattatcgcgagcccatttatacccatataaatcagcatccatgttggaatttaatcgcggcctcgagca
agacgtttcccgttgaatatggctcataacaccccttgtattactgtttatgtaagcagacagttttattgttca
tgatgatatatttttatcttgtgcaatgtaacatcagagattttgagacacaacgtggctttcccccccccccca
ttattgaagcatttatcagggttattgtctcatgagcggatacatatttgaatgtatttagaaaaataaacaaat
aggggttccgcgcacatttccccgaaaagtgccacctgacgtctaagaaaccattattatcatgacattaaccta
taaaaataggcgtatcacgaggccctttcgtc

Figure 24A

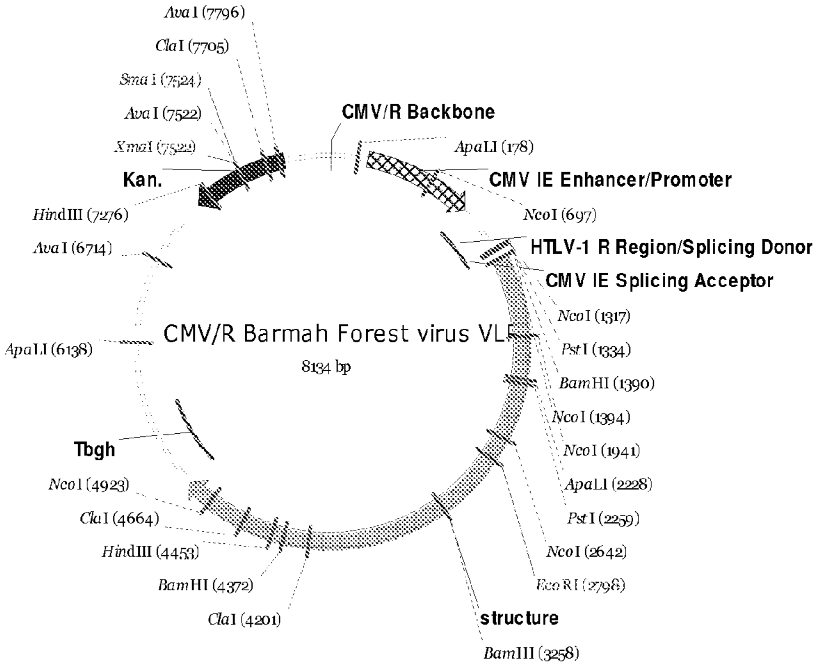

Figure 24B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagaccaggccctggatccatggatttcatccccacccaaaccttctatg
gtagacgatggagaccagcaccagtccagagatacataccccaaccccaaccaccagcgcctccacgccgtagga
gaggaccatctcaactccaacagcttgtggctgcattgggcgcactagctctacaacccaagcagaaacaaaaaa
gagcacagaagaagcccaagaagacaccaccaccaaaaccaaaaaagacccagaagcctaagaaaccaacccaaa
agaagaagtccaaacccggcaaacgtatgcgtaactgcatgaagatcgagaatgactgcatctttccggtgatgc
tcgatggaaaggttaacggctacgcttgcttagtggggataaagtcatgaaaccagctcatgtgaagggcacga
tcgacaatccagaactagccaaattgacattcaagaaatctagcaagtatgatctagaatgtgctcaagtgccgg
tatgcatgaaatcagacgcatccaagttcacccatgagaaaccagaaggacattacaactggcaccatggggcag
tgcaatttagcaatggtaggtttaccattccgacgggctctggcaaacctggagacagtggtaggcctattttg
acaataccggcaaggtagtagccatagtgctgggaggtgcaaatgaagggcccggacagccctatccgtggtca
cctggaataaggatatggtgacccgcataacacctgaagaatcagtggagtggtcggcggccgcactgnatataa
cagcactatgtgtcctccagaacttatcgttcccgtgtgatgcaccaccatgtgcaccatgctgttacgaaaag
accctgcagggaccctaagattgctgtctgaccactactaccaccccaagtattatgaattacttgactcgacga

Figure 24B continued tgcactgcccacaaggaaggagacctaagaggtctgttgcgcatttcgaagcctacaaggctacgagaccgtata
tagggtggtgcgcagattgtggactggcaggatcatgcccatcccctgtgagcatcgagcacgtctggagtgatg
ccgacgacggcgtactgaagatccaagtgtccatgcagatccgtatagctaaaagcaatactattaaccacgcta
agatacgttacatgggtgccaatggagtacaggaggctgaacgctctaccctaagtgtatccacaacagcaccat
gtgacatcttggcgaccatgggccatttcatcttggcccgctgccgacccggcagtcaagttgaagtatcactaa
gcaccgatccaaagctgctatgccgtacaccattctcccacaagcccaggtttattggcaatgaaaagtccccag
cacccaccgggcacaagacccgaattccctgcaaaacttactcccatcagacagacttaacgagagaagagatta
caatgcatgtaccgccggatgtccccatccaagggctagtgtccaatacaggtaagtcgtactcattagacccaa
agacgaagaccatcaagtacaaatgcacttgcggcgagactgtaaaagaaggtactgctacgaacaaaatcacac
tgttcaattgtgacaccgccccaaagtgtattacatatgcagtggataacacagtgtggcagtacaactcccaat
acgtgcccaggtccgaagttacggaggtgaaaggaaagatccatgtgcctttccctctgaccgacagcacgtgtg
cagtcagcgtagcacctgaaccgcaagtgacatacagactgggggaagtggagttccacttccaccctatgtacc
ccaccctcttctccattaggagcctcggaaaggatccgagccacagtcaagaatggatagatacacccatgagca
agacaatccaagttggggcagaaggcgtggagtatgtctggggaaacaacaacccggtacgactatgggcacaga
agagctcatcgagcagcgcgcatggtaaccctattagcatagtctcacattactatgacctgtacccttactgga
ccatcacagtactagcgagtctaggcttgctaatagtgattagttccggtttttcatgctttttgtgttcagtcg
ctcgaaccaaatgccttacaccctatcaattagcaccaggcgcccaattacccacatttatagcactcctttgct
gcgctaagtctgcacgcgcagacactttagatgatttttcctacctgtggaccaacaaccaagccatgttttggc
tccaactggcatctccggttgcagcgttcttgtgcttatcctattgctgtagaaatctagcatgctgtatgaaga
tttttttaggataagcggcctgtgtgtaattgccacgcaggcctacgagcactcaaccacgatgccgaatcagg
tgggaataccgtttaaagccttgatagagcgaccaggttacgcaggcctcccgctatctttagtagtgattaagt
cagaattagtcccctcattagttcaggattatattacctgcaactacaagactgtggtcccgtctccgtacatta
aatgttgcggaggcgctgagtgttcacacaaaaatgaagcggactataagtgctcggtgttcacaggcgtgtacc
cgtttatgtggggaggcgcctactgcttctgtgacaccgaaaacagtcagatgagtgaagtatacgtaaccagag
gagaatcatgcgaggctgaccatgccatcgcttatcaggtacacacagcatcgcttaaggcacaagtaatgatat
cgattggagaactgaaccaaaccgtcgacgtgtttgtcaacggagacagtccagccagaatccaacaatcaaagt
tcatacttgggccgatatccagtgcctggtctcctttgatcacaaggtgatcgtatacagggatgaggtgtaca
atgaagactacgcaccgtacggatccggccaagcaggcaggttcggagacatccaaagtagaactgttaacagca
ctgatgtctatgccaacaccaatttgaagcttaaaagaccggcttcaggcaatgttcatgtaccatacacgcaaa
ccccttcgggtttctcgtactggaaaaagagaagggagtaccattgaatcgaaacgcccctttttggctgtatca
tcaaagtcaatccagtacgtgctgaaaactgcgtatatggcaacataccgatcagtatggatattgcggacgcgc
acttcacaaggatcgatgaatccccgtctgtgtccttgaaggcgtgtgaagtgcagtcctgcacttattcatcgg
attttggcggagtagcgagcatttcctacacatctaataaggtaggtaagtgtgccatccacagccactcgaact
ccgcaacgatgaaggattctgtgcaggatgtccaggaaagcggcgccttgtcgctttctttgcgacttcctctg
tcgagccgaacttcgtggtccaagtgtgtaacgcgcggatcacttgccatggtaagtgtgaaccaccgaaagacc
acatcgtaccatacgcagccaaacacaacgacgccgagtttccatccatctctactacagcttggcaatggttgg
cacacaccacctcagggccactcaccatacttgtggtagctattatagtcgttgttgtagtatccattgtagtat
gtgcaagacactagagatctgctgtgccttctagttgccagccatctgttgtttgcccctcccccgtgccttcct
tgaccctggaaggtgccactcccactgtcctttcctaataaaatgaggaaattgcatcgcattgtctgagtaggt
gtcattctattctggggggtggggtggggcaggacagcaagggggaggattgggaagacaatagcaggcatgctg
gggatgcggtgggctctatgggtacccaggtgctgaagaattgacccggttcctcctgggccagaaagaagcagg
cacatccccttctctgtgacacaccctgtccacgcccctggttcttagttccagccccactcataggacactcat
agctcaggagggctccgccttcaatcccacccgctaaagtacttggagcggtctctccctccctcatcagcccac
caaaccaaacctagcctccaagagtgggaagaaattaaagcaagataggctattaagtgcagagggagagaaaat
gcctccaacatgtgaggaagtaatgagagaaatcatagaatttaaggccatgatttaaggccatcatggcctta
atcttccgcttcctcgctcactgactcgctgcgctcggtcgttcggctgcggcgagcggtatcagctcactcaaa
ggcggtaatacggttatccacagaatcaggggataacgcaggaaagaacatgtgagcaaaaggccagcaaaaggc
caggaaccgtaaaaaggccgcgttgctggcgtttttccataggctccgcccccctgacgagcatcacaaaaatcg
acgctcaagtcagaggtggcgaaacccgacaggactataaagataccaggcgtttccccctggaagctccctcgt
gcgctctcctgttccgaccctgccgcttaccggatacctgtccgcctttctcccttcgggaagcgtggcgctttc
tcatagctcacgctgtaggtatctcagttcggtgtaggtcgttcgctccaagctgggctgtgtgcacgaaccccc
cgttcagcccgaccgctgcgccttatccggtaactatcgtcttgagtccaacccggtaagacacgacttatcgcc
actggcagcagccactggtaacaggattagcagagcgaggtatgtaggcggtgctacagagttcttgaagtggtg
gcctaactacggctacactagaagaacagtatttggtatctgcgctctgctgaagccagttaccttcggaaaaag
agttggtagctcttgatccggcaaacaaaccaccgctggtagcggtggtttttttgtttgcaagcagcagattac
gcgcagaaaaaaaggatctcaagaagatcctttgatcttttctacggggtctgacgctcagtggaacgaaaactc
acgttaagggattttggtcatgagattatcaaaaaggatcttcacctagatccttttaaattaaaaatgaagttt
taaatcaatctaaagtatatatgagtaaacttggtctgacagttaccaatgcttaatcagtgaggcacctatctc
agcgatctgtctatttcgttcatccatagttgcctgactccccccggggggggggcgctgaggtctgcctcgtgaaga
aggtgttgctgactcataccaggcctgaatcgccccatcatccagccagaaagtgagggagccacggttgatgag
agctttgttgtaggtggaccagttggtgattttgaacttttgctttgccacggaacgtctgcgttgtcgggaag

Figure 24B continued atgcgtgatctgatccttcaactcagcaaaagttcgatttattcaacaaagccgccgtcccgtcaagtcagcgta
atgctctgccagtgttacaaccaattaaccaattctgattagaaaaactcatcgagcatcaaatgaaactgcaat
ttattcatatcaggattatcaataccatatttttgaaaaagccgtttctgtaatgaaggagaaaactcaccgagg
cagttccataggatggcaagatcctggtatcggtctgcgattccgactcgtccaacatcaatacaacctattaat
ttcccctcgtcaaaaataaggttatcaagtgagaaatcaccatgagtgacgactgaatccggtgagaatggcaaa
agcttatgcatttctttccagacttgttcaacaggccagccattacgctcgtcatcaaaatcactcgcatcaacc
aaaccgttattcattcgtgattgcgcctgagcgagacgaaatacgcgatcgctgttaaaaggacaattacaaaca
ggaatcgaatgcaaccggcgcaggaacactgccagcgcatcaacaatattttcacctgaatcaggatattcttct
aatacctggaatgctgttttcccggggatcgcagtggtgagtaaccatgcatcatcaggagtacggataaaatgc
ttgatggtcggaagaggcataaattccgtcagccagtttagtctgaccatctcatctgtaacatcattggcaacg
ctacctttgccatgtttcagaaacaactctggcgcatcgggcttcccatacaatcgatagattgtcgcacctgat
tgcccgacattatcgcgagcccatttatacccatataaatcagcatccatgttggaatttaatcgcggcctcgag
caagacgtttcccgttgaatatggctcataacaccccttgtattactgtttatgtaagcagacagttttattgtt
catgatgatatattttatcttgtgcaatgtaacatcagagattttgagacacaacgtggctttcccccccccccc
cattattgaagcatttatcagggttattgtctcatgagcggatacatatttgaatgtatttagaaaaataaacaa
ataggggttccgcgcacatttccccgaaaagtgccacctgacgtctaagaaaccattattatcatgacattaacc
tataaaaataggcgtatcacgaggccctttcgtc

Figure 25A

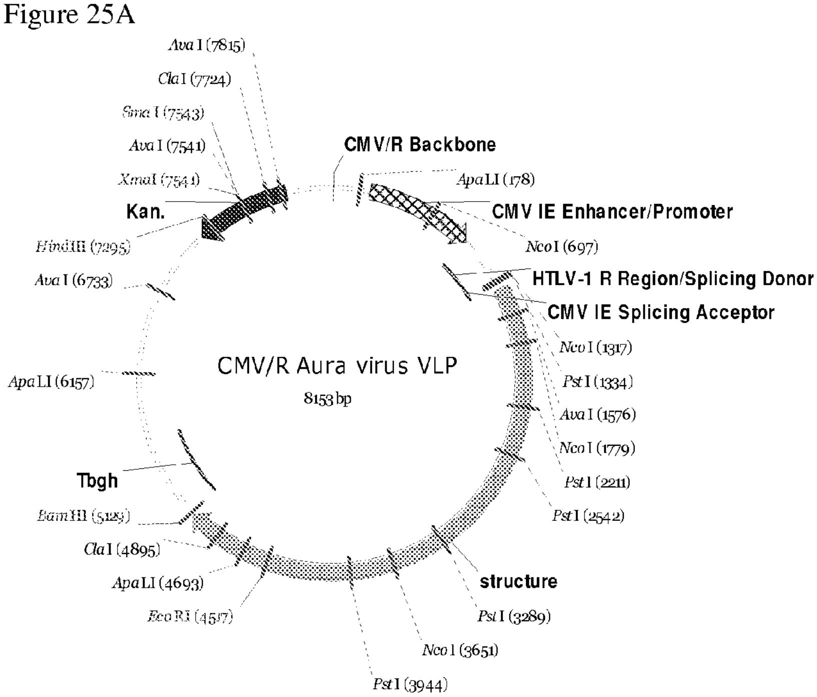

Figure 25B tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgaactctgtcttttacaatccgtttggccgaggtgcctacgctcaa
cctccaatagcatggaggccaagacgtagggctgcacctgcgcctcgaccatccgggttgactacccagatccaa
cagctcactagggctgttagagctttggtgctggacaatgctacacgtcgccagcgcccggctcctcgcacgcgc
ccgaggaagccgaagactcaaaaacctaagccgaagaagcaaaaccagaaaccaccacaacagcagaagaaaggg
aaaaatcagccccaacaaccgaagaaaccgaagcccggtaaacgacagcgtaccgccctgaaatttgaagccgac
cgcacatttgtcgggaagaatgaagacggcaagattatgggatacgccgttgccatggaagggaaagtgataaaa
ccactacatgtaaaggaaccattgaccacccggccctagcgaaacttaaattcactaaatcttcttcttacgac
atggagtttgctaaactaccgaccgaaatgaaaagcgacgcattcgggtatacaacggaacaccccgaagtattt
tacaactggcatcacggagctgtccaattttccggcggaaggttcaccatccctacaggagtcggaggccccgga
gatagcggaaggcctatactggataactccggaaaagtggtagccatagtcctaggaggagctaatgaagtgcca
ggaacggcactttctgttgtcacctggaataagaagggagccgctattaaaacccacccacgaagatactgtagag
tggtcgcgggctattaccgctatgtgcatcctgcagaacgtcacattcccatgtgaccgaccgccaacttgctat
aatcgtaatcctgacttgaccctaaccatgttggaaacaaatgtcaatcacccttcgtacgacgttctgctggac

Figure 25B continued gctgctctgaggtgccccacgagacggcacgtcagatcaacgcccaccgatgacttcactctcacagcaccgtac
ctcggcttgtgtcacagatgtaagacgatggaaccatgctacagccctataaaatcgaaaaagtgtgggatgat
gccgatgacggagttctccgtatacaagtaagtgcccagttagggtacaacagggcgggcactgcagctagcgcc
cgactccggttcatgggcggaggagtgcctccggaaatccaggagggagcaattgcagattttaaggtcttcacg
tccaaaccatgtttacacctatcacataaaggatactttgtcattgtcaagtgccctcctggtgatagtattaca
acatcattgaaagtgcatggctcggatcaaacctgcacaattccaatgcgagtaggttacaagttcgtaggcagg
gaaaaatatactctgccaccaatgcatgggacacaaataccttgccttacctacgaaaggacacgagagaaaagt
gcaggatacgtgaccatgcatcgtcccggacaacaatccataaccatgctgatggaagagagcggaggggaggtg
tacgtacaaccgaccagtgggcgaaacgtcacctacgagtgtaaatgcggagactttaaaactgggactgtcact
gcgcgcactaaaatagacggctgtacagaaaggaaacaatgcattgcgatttctgccgaccacgtcaaatgggtg
tttaactcccctgacttgatcaggcataccgaccacacagcccaagggaagttgcatataccattcccgctacag
caggctcaatgtacagtaccactggcgcaccttccaggcgttaagcatgcttatcgcagtatgtctctgacactg
cacgctgagcatcctacattgcttactacccgccatcttggagaaatcctcagcccactgcagaatggattgtc
gggagtgtaactcgaaacttctccataaccatacaagggttcgagtatacttggggaaatcagaaaccggtccga
gtgtacgcgcaggaatcggcacctggcaatcctcatggctggccacatgaaatcgtacgccattactaccacctc
tatcccttctacaccgttacagtgctgagcggcatgggactggccatatgcgctggcttagtgatcagtatttta
tgctgctgcaaagcaagaagggattgcctaacaccttaccaactggccccgaacgctaccgtaccatttctggta
acattgtgttgctgtttccaacggacttcagcggatgaatttaccgataccatggggtacctatggcaacacagt
caaacaatgttctggatacaattggtcatacctttagcagcagtgataactttggttagatgttgctcctgctgt
ctaccttttttattggttgccagtcctcctaacaaagcggacgcctacgaacatacgatcactgtcccaaatgcg
ccgttgaactcgtataaagcactagtggaacggcctgggtatgccccttgaatcttgaagtcatggtcatgaac
acccagatcataccatcggttaaacgtgaatacattacctgcaggtaccacaccgttgttccttcaccgcagatt
aaatgttgcggaactgtcgaatgcccgaaaggtgaaaaagcagactatacctgcaaggtgttcactggtgtgtac
ccatttctgtggggaggagcacagtgtttttgcgactccgaaaacagtcagcttagcgacaagtacgtcgaactg
tcaacagattgcgccacagaccatgccgaggcggtcagagtacacacggcttcggtgaaatcacagctccgaata
acctacgggaactccacagcacaagtagacgtatttgtcaacggtgtgactccagccaggagcaaagacatgaaa
ttgatagccggcccattatctactacattttccccgtttgataataaggtcattatatatcatgggaaagtctat
aactatgacttcccggaatttggggccggaacacctggagctttcggagatgtccaagcgtcatccaccaccgga
tcagatctattagcaaacacagcaattcatttgcagaggccggaagccagaaacatacacgtcccgtacacccaa
gctccaagcgggttcgaattctggaagaataacagcggtcagcctttatctgacactgcccctttcggatgcaaa
gtcaatgtcaacccgctacgtgcagacaagtgtgccgtgggatcactcccgatatccgtggatataccggacgct
gcatttacacgcgtatccgagcccctgccatcactgcttaagtgcaccgttactagttgcacatactctacagac
tatggcggagtgctcgtgttgacatacgagtcggatcgcgcggggcaatgcgctgtacactcgcattcatcaaca
gcggtactgcgagacccatcggtatacgtcgagcaaaaggggagactacacttaaatttagtacgcgttccttg
caggcagacttcgaggtatcgatgtgcggaacgagaaccacttgccatgcccaatgtcaaccaccaacggaacac
gtaatgaacagaccccagaagtcgactccagacttctcctcagcgatatccaaaacatcatggaactggattaca
gcgcttatgggggaatttccagtatagctgctatagccgcaattgtgctggtcatagcattagtatttacagca
caacacagatgatctagaccaggccctggatccagatctgctgtgccttctagttgccagccatctgttgtttgc
ccctcccccgtgccttccttgaccctggaaggtgccactcccactgtcctttcctaataaaatgaggaaattgca
tcgcattgtctgagtaggtgtcattctattctggggggtggggtggggcaggacagcaagggggaggattgggaa
gacaatagcaggcatgctggggatgcggtgggctctatgggtacccaggtgctgaagaattgacccggttcctcc
tgggccagaaagaagcaggcacatccccttctctgtgacacaccctgtccacgcccctggttcttagttccagcc
ccactcataggacactcatagctcaggagggctccgccttcaatcccacccgctaaagtacttggagcggtctct
ccctccctcatcagcccaccaaaccaaacctagcctccaagagtgggaagaaattaaagcaagataggctattaa
gtgcagagggagagaaaatgcctccaacatgtgaggaagtaatgagagaaatcatagaattttaaggccatgatt
taaggccatcatggccttaatcttccgcttcctcgctcactgactcgctgcgctcggtcgttcggctgcggcgag
cggtatcagctcactcaaaggcggtaatacggttatccacagaatcaggggataacgcaggaaagaacatgtgag
caaaaggccagcaaaaggccaggaaccgtaaaaaggccgcgttgctggcgtttttccataggctccgcccccctg
acgagcatcacaaaaatcgacgctcaagtcagaggtggcgaaacccgacaggactataaagataccaggcgtttc
cccctggaagctccctcgtgcgctctcctgttccgaccctgccgcttaccggatacctgtccgcctttctccctt
cgggaagcgtggcgctttctcatagctcacgctgtaggtatctcagttcggtgtaggtcgttcgctccaagctgg
gctgtgtgcacgaaccccccgttcagcccgaccgctgcgccttatccggtaactatcgtcttgagtccaacccgg
taagacacgacttatcgccactggcagcagccactggtaacaggattagcagagcgaggtatgtaggcggtgcta
cagagttcttgaagtggtggcctaactacggctacactagaagaacagtatttggtatctgcgctctgctgaagc
cagttaccttcggaaaaagagttggtagctcttgatccggcaaacaaaccaccgctggtagcggtggtttttttg
tttgcaagcagcagattacgcgcagaaaaaaaggatctcaagaagatcctttgatcttttctacggggtctgacg
ctcagtggaacgaaaactcacgttaagggattttggtcatgagattatcaaaaaggatcttcacctagatccttt
taaattaaaaatgaagttttaaatcaatctaaagtatatatgagtaaacttggtctgacagttaccaatgcttaa
tcagtgaggcacctatctcagcgatctgtctatttcgttcatccatagttgcctgactccccccccccgcgct
gaggtctgcctcgtgaagaaggtgttgctgactcataccaggcctgaatcgccccatcatccagccagaaagtga
gggagccacggttgatgagagctttgttgtaggtggaccagttggtgattttgaacttttgctttgccacggaac

Figure 25B continued ggtctgcgttgtcgggaagatgcgtgatctgatccttcaactcagcaaaagttcgatttattcaacaaagccgcc
gtcccgtcaagtcagcgtaatgctctgccagtgttacaaccaattaaccaattctgattagaaaaactcatcgag
catcaaatgaaactgcaatttattcatatcaggattatcaataccatatttttgaaaaagccgtttctgtaatga
aggagaaaactcaccgaggcagttccataggatggcaagatcctggtatcggtctgcgattccgactcgtccaac
atcaatacaacctattaatttcccctcgtcaaaaataaggttatcaagtgagaaatcaccatgagtgacgactga
atccggtgagaatggcaaaagcttatgcatttctttccagacttgttcaacaggccagccattacgctcgtcatc
aaaatcactcgcatcaaccaaaccgttattcattcgtgattgcgcctgagcgagacgaaatacgcgatcgctgtt
aaaaggacaattacaaacaggaatcgaatgcaaccggcgcaggaacactgccagcgcatcaacaatattttcacc
tgaatcaggatattcttctaatacctggaatgctgttttcccggggatcgcagtggtgagtaaccatgcatcatc
aggagtacggataaaatgcttgatggtcggaagaggcataaattccgtcagccagtttagtctgaccatctcatc
tgtaacatcattggcaacgctacctttgccatgtttcagaaacaactctggcgcatcgggcttcccatacaatcg
atagattgtcgcacctgattgcccgacattatcgcgagcccatttatacccatataaatcagcatccatgttgga
atttaatcgcggcctcgagcaagacgtttcccgttgaatatggctcataacaccccttgtattactgtttatgta
agcagacagttttattgttcatgatgatatatttttatcttgtgcaatgtaacatcagagattttgagacacaac
gtggctttccccccccccccattattgaagcatttatcagggttattgtctcatgagcggatacatatttgaatg
tatttagaaaaataaacaaataggggttccgcgcacatttccccgaaaagtgccacctgacgtctaagaaaccat
tattatcatgacattaacctataaaaataggcgtatcacgaggccctttcgtc

Figure 26B

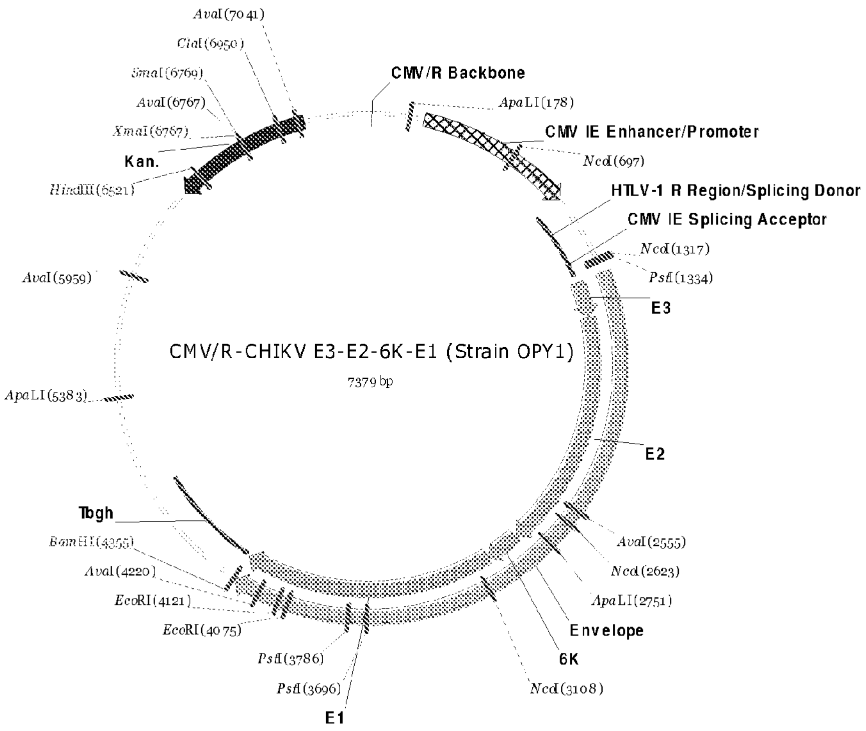

Figure 26C atgagcctcgccctcccggtcttgtgcctgttggcaaacactacattcccctgctctcagccgccttgcacaccc
tgctgctacgaaaaggaaccggaaagcaccttgcgcatgcttgaggacaacgtgatgagacccggatactaccag
ctactaaaagcatcgctgacttgctctccccaccgccaaagacgcagtactaaggacaattttaatgtctataaa
gccacaagaccatatctagctcattgtcctgactgcggagaagggcattcgtgccacagccctatcgcattggag
cgcatcagaaatgaagcaacggacggaacgctgaaaatccaggtctctttgcagatcgggataaagacagatgac
agccacgattggaccaagctgcgctatatggatagccatacgccagcggacgcggagcgagccggattgcttgta
aggacttcagcaccgtgcacgatcaccgggaccatgggacactttattctcgcccgatgcccgaaaggagagacg
ctgacagtgggatttacggacagcagaaagatcagccacacatgcacacacccgttccatcatgaaccacctgtg
ataggtagggagaggttccactctcgaccacaacatggtaaagagttaccttgcagcacgtacgtgcagagcacc
gctgccactgctgaggagatagaggtgcatatgcccccagatactcctgaccgcacgctgatgacgcagcagtct
ggcaacgtgaagatcacagttaatgggcagacggtgcggtacaagtgcaactgcggtggctcaaacgagggactg
acaaccacagacaaagtgatcaataactgcaaaattgatcagtgccatgctgcagtcactaatcacaagaattgg
caatacaactcccctttagtcccgcgcaacgctgaactcggggaccgtaaaggaaagatccacatcccattccca
ttggcaaacgtgacttgcagagtgccaaaagcaagaaaccctacagtaacttacggaaaaaaccaagtcaccatg
ctgctgtatcctgaccatccgacactcttgtcttaccgtaacatgggacaggaaccaaattaccacgaggagtgg
gtgacacacaagaaggaggttaccttgaccgtgcctactgagggtctggaggtcacttggggcaacaacgaacca
tacaagtactggccgcagatgtctacgaacggtactgctcatggtcacccacatgagataatcttgtactattat
gagctgtaccccactatgactgtagtcattgtgtcggtggcctcgttcgtgcttctgtcgatggtgggcacagca
gtgggaatgtgtgtgtgcgcacggcgcagatgcattacaccatatgaattaacaccaggagccactgttcccttc
ctgctcagcctgctatgctgcgtcagaacgaccaaggcggccacatattacgaggctgcggcatatctatggaac
gaacagcagcccctgttctggttgcaggctcttatcccgctggccgccttgatcgtcctgtgcaactgtctgaaa
ctcttgccatgctgctgtaagaccctggctttttagccgtaatgagcatcggtgcccacactgtgagcgcgtac
gaacacgtaacagtgatcccgaacacggtgggagtaccgtataagactcttgtcaacagaccgggttacagcccc
atggtgttggagatggagctacaatcagtcaccttggaaccaacactgtcacttgactacatcacgtgcgagtac
aaaactgtcatcccctccccgtacgtgaagtgctgtggtacagcagagtgcaaggacaagagcctaccagactac
agctgcaaggtctttactggagtctacccatttatgtggggcggcgcctactgcttttgcgacgccgaaaatacg
caattgagcgaggcacatgtagagaaatctgaatcttgcaaaacagagtttgcatcggcctacagagcccacacc
gcatcggcgtcggcgaagctccgcgtcctttaccaaggaaacaacattaccgtagctgcctacgctaacggtgac

Figure 26C continued catgccgtcacagtaaaggacgccaagtttgtcgtgggcccaatgtcctccgcctggacaccttttgacaacaaa
atcgtggtgtacaaaggcgacgtctacaacatggactacccaccttttggcgcaggaagaccaggacaatttggt
gacattcaaagtcgtacaccggaaagtaaagacgtttatgccaacactcagttggtactacagaggccagcagca
ggcacggtacatgtaccatactctcaggcaccatctggcttcaagtattggctgaaggaacgaggagcatcgcta
cagcacacggcaccgttcggttgccagattgcgacaaacccggtaagagctgtaaattgcgctgtgggaacata
ccaatttccatcgacataccggatgcggcctttactagggttgtcgatgcaccctctgtaacggacatgtcatgc
gaagtaccagcctgcactcactcctccgactttgggggcgtcgccatcatcaaatacacagctagcaagaaaggt
aaatgtgcagtacattcgatgaccaacgccgttaccattcgagaagccgacgtagaagtagaggggaactcccag
ctgcaaatatccttctcaacagccctggcaagcgccgagtttcgcgtgcaagtgtgctccacacaagtacactgc
gcagccgcatgccaccctccaaaggaccacatagtcaattacccagcatcacacaccacccttggggtccaggat
atatccacaacggcaatgtcttgggtgcagaagattacgggaggagtaggattaattgttgctgttgctgcctta
attttaattgtggtgctatgcgtgtcgtttagcaggcacatgagtcttgccatcccagttatgtgcctgttggca
aacaccacgttcccctgctcccagccccttgcacgccctgctgctacgaaaaggaaccggaggaaaccctacgc
atgcttgaggacaacgtcatgagacctgggtactatcagctgctacaagcatccttaacatgttctccccaccgc
cagcgacgcagcaccaaggacaacttcaatgtctataaagccacaagaccatacttagctcactgtcccgactgt
ggagaagggcactcgtgccatagtcccgtagcactagaacgcatcagaaatgaagcgacagacggacgctgaaa
atccaggtctccttgcaaatcggaataaagacggatgacagccacgattggaccaagctgcgttatatcgacaac
cacatgccagcagacgcagagagggcggggctatttgtaagaacatcagcaccgtgtacgattactggaacaatg
ggacacttcatcctggcccgatgtccaaaaggggaaactctgacggtgggattcactgacagtaggaagattagt
cactcatgtacgcacccatttcaccacgaccctcctgtgataggtcgggaaaaattccattcccgacccgcagcac
ggtaaagagctaccttgcagcacgtacgtgcagagcaccgccgcaactaccgaggagatagaggtacacatgccc
ccagacacccctgatcgcacattaatgtcacaacagtccggcaacgtaaagatcacagtcaatggccagacggtg
cggtacaagtgtaattgcggtggctcaaatgaaggactaacaactacagacaaagtgattaataactgcaaggtt
gatcaatgtcatgccgcggtcaccaatcacaaaaagtggcagtataactcccctctggtcccgcgtaatgctgaa
cttggggaccgaaaaggaaaaattcacatcccgtttccgctggcaaatgtaacatgcagggtgcctaaagcaagg
aaccccaccgtgacgtacgggaaaaaccaagtcatcatgctactgtatcctgaccacccaacactcctgtcctac
cggaatatgggagaagaaccaaactatcaagaagagtgggtgatgcataagaaggaagtcgtgctaaccgtgccg
actgaagggctcgaggtcacgtggggcaacaacgagccgtataagtattggccgcagttatctacaaacggtaca
gcccatggccacccgcatgagataattctgtattattatgagctgtaccccactatgactgtagtagttgtgtca
gtggccacgttcatactcctgtcgatggtgggtatggcagcggggatgtgcatgtgtgcacgacgcagatgcatc
acaccgtatgaactgacaccaggagctaccgtccctttcctgcttagcctaatatgctgcatcagaacagctaaa
gcggccacataccaagaggctgcgatatacctgtggaacgagcagcaacctttgttttggctacaagcccttatt
ccgctggcagccctgattgttctatgcaactgtctgagactcttaccatgctgctgtaaaacgttggcttttta
gccgtaatgagcgtcggtgcccacactgtgagcgcgtacgaacacgtaacagtgatcccgaacacggtgggagta
ccgtataagactctagtcaatagacctggctacagccccatggtattggagatggaactactgtcagtcactttg
gagccaacactatcgcttgattacatcacgtgcgagtacaaaaccgtcatcccgtctccgtacgtgaagtgctgc
ggtacagcagagtgcaaggacaaaaacctacctgactacagctgtaaggtcttcaccggcgtctacccatttatg
tggggcggcgcctactgcttctgcgacgctgaaaacacgcagttgagcgaagcacacgtggagaagtccgaatca
tgcaaaacagaatttgcatcagcatacagggctcataccgcatctgcatcagctaagctccgcgtcctttaccaa
ggaaataacatcactgtaactgcctatgcaaacggcgaccatgccgtcacagttaaggacgccaaattcattgtg
gggccaatgtcttcagcctggacacctttcgacaacaaaattgtggtgtacaaaggtgacgtctataacatggac
tacccgccctttggcgcaggaagaccaggacaatttggcgatatccaaagtcgcacacctgagagtaaagacgtc
tatgctaatacacaactggtactgcagagaccggctgtgggtacggtacacgtgccatactctcaggcaccatct
ggctttaagtattggctaaaagaacgcggggcgtcgctgcagcacacagcaccatttggctgccaaatagcaaca
aacccggtaagagcggtgaactgcgccgtagggaacatgcccatctccatcgacataccggaagcggccttcact
agggtcgtcgacgcgccctctttaacggacatgtcgtgcgaggtaccagcctgcacccattcctcagactttggg
ggcgtcgccattattaaatatgcagccagcaagaaaggcaagtgtgcggtgcattcgatgactaacgccgtcact
attcgggaagctgagatagaagttgaagggaattctcagctgcaaatctctttctcgacggccttagccagcgcc
gaattccgcgtacaagtctgttctacacaagtacactgtgcagccgagtgccacccccgaaggaccacatagtc
aactacccggcgtcacataccaccctcggggtccaggacatctccgctacggcgatgtcatgggtgcagaagatc
acgggaggtgtgggactggttgttgctgttgccgcactgattctaatcgtggtgctatgcgtgtcgttcagcagg
cacatggagttcatcccgacgcaaactttctataacagaaggtaccaaccccgaccctggccccacgccctaca
attcaagtaattagacctagaccacgtccacagaggcaggctgggcaactcgcccagctgatctccgcagtcaac
aaattgaccatgcgcgcggtacctcaacagaagcctcgcagaaatcggaaaaacaagaagcaaaggcagaagaag
caggcgccgcaaaacgacccaaagcaaaagaagcaaccaccacaaaagaagccggctcaaaagaagaagaaacca
ggccgtagggagagaatgtgcatgaaaattgaaaatgattgcatcttcgaagtcaagcatgaaggcaaagtgatg
ggctacgcatgcctggtgggggataaagtaatgaaaccagcacatgtgaagggaactatcgacaatgccgatctg
gctaaactggcctttaagcggtcgtctaaatacgatcttgaatgtgcacagataccggtgcacatgaagtctgat
gcctcgaagtttacccacgagaaacccgaggggtactataactggcatcacggagcagtgcagtattcaggaggc
cggttcactatcccgacgggtgcaggcaagccgggagacagcggcagaccgatcttcgacaacaaaggacgggtg
gtggccatcgtcctaggaggggccaacgaaggtgcccgcacggccctctccgtggtgacgtggaacaaagacatc

Figure 26C continued gtcacaaaaattacccctgagggagccgaagagtggatggagttcatcccaacccaaactttttacaataggagg
taccagcctcgaccctggactccgcgccctactatccaagtcatcaggcccagaccgcgccctcagaggcaagct
gggcaacttgcccagctgatctcagcagttaataaactgacaatgcgcgcggtaccacaacagaagccacgcagg
aatcggaagaataagaagcaaaagcaaaaacaacaggcgccacaaaacaacacaaatcaaaagaagcagccacct
aaaaagaaaccggctcaaaagaaaaagaagccgggccgcagagagaggatgtgcatgaaaatcgaaaatgattgt
attttcgaagtcaagcacgaaggtaaggtaacaggttacgcgtgcctggtgggggacaaagtaatgaaaccagca
cacgtaaaggggaccatcgataacgcggacctggccaaactggcctttaagcggtcatctaagtatgaccttgaa
tgcgcgcagatacccgtgcacatgaagtccgacgcttcgaagttcacccatgagaaaccggaggggtactacaac
tggcaccacggagcagtacagtactcaggaggccggttcaccatccctacaggtgctggcaaaccaggggacagc
ggcagaccgatcttcgacaacaagggacgcgtggtggccatagtcttaggaggagctaatgaaggagcccgtaca
gccctctcggtggtgacctggaataaagacattgtcactaaaatcacccccgagggggccgaagagtgg

Figure 27

```
   1 atggctgcgt gagacacacg tagcctacca gtttcttact gctctactct gcaaagcaag
  61 agattaataa cccatcatgg atcctgtgta cgtggacata gacgctgaca gcgccttttt
 121 gaaggccctg caacgtgcgt accccatgtt tgaggtggaa ccaaggcagg tcacaccgaa
 181 tgaccatgct aatgctagag cgttctcgca tctagctata aaactaatag agcaggaaat
 241 tgaccccgac tcaaccatcc tggatatcgg cagtgcgcca gcaaggagga tgatgtcgga
 301 caggaagtac cactgcgtct gcccgatgcg cagtgcggaa gatcccgaga gactcgccaa
 361 ttatgcgaga aagctagcat ctgccgcagg aaaagtcctg gacagaaaca tctctggaaa
 421 gatcggggac ttacaagcag taatggccgt gccagacacg gagacgccaa cattctgctt
 481 acacacagac gtctcatgta gacagagagc agacgtcgct atataccaag acgtctatgc
 541 tgtacacgca cccacgtcgc tataccacca ggcgattaaa ggggtccgag tggcgtactg
 601 ggttgggttc gacacaaccc cgttcatgta caatgccatg gcgggtgcct accccctcata
 661 ctcgacaaac tgggcagatg agcaggtact gaaggctaag aacataggat tatgttcaac
 721 agacctgacg gaaggtagac gaggcaagtt gtctattatg agagggaaaa agctaaaacc
 781 gtgcgaccgt gtgctgttct cagtagggtc aacgctctac ccggaaagcc gcaagctact
 841 taagagctgg cacctgccat cggtgttcca tttaaagggc aaactcagct tcacatgccg
 901 ctgtgataca gtggtttcgt gtgagggcta cgtcgttaag agaataacga tgagcccagg
 961 cctttatgga aaaaccacag ggtatgcggt aacccaccac gcagacggat tcctgatgtg
1021 caagactacc gacacggttg acggcgaaag aatgtcattc tcggtgtgca catacgtgcc
1081 ggcgaccatt tgtgatcaaa tgaccggcat ccttgctaca gaagtcacgc cggaggatgc
1141 acagaagctg ttggtggggc tgaaccagag aatagtggtt aacggcagaa cgcaacggaa
1201 tacgaacacc atgaaaaatt atctgcttcc cgtggtcgcc caagccttca gtaagtgggc
1261 aaaggagtgc cggaaagaca tggaagatga aaaactcctg gggtcagag aaagaacact
1321 gacctgctgc tgtctatggg cattcaagaa gcagaaaaca cacacggtct acaagaggcc
1381 tgatacccag tcaattcaga aggttcaggc cgagtttgac agctttgtgg taccgagtct
1441 gtggtcgtcc gggttgtcaa tccctttgag gactagaatc aaatggttgt taagcaaggt
1501 gccaaaaacc gacctgatcc catacagcgg agacgcccga gaagcccggg acgcagaaaa
1561 agaagcagag gaagaacgag aagcagaact gactcgcgaa gccctaccac ctctacaggc
1621 agcacaggaa gatgttcagg tcgaaatcga cgtggaacag cttgaggaca gagcgggcgc
1681 aggaataata gagactccga gaggagctat caaagttact gcccaaccaa cagaccacgt
1741 cgtgggagag tacctggtac tctccccgca gaccgtacta cgtagccaga agctcagtct
1801 gattcacgct ttggcggagc aagtgaagac gtgcacgcac aacggacgag cagggaggta
1861 tgcggtcgaa gcgtacgacg gccgagtcct agtgccctca ggctatgcaa tctcgcctga
1921 agacttccag agtctaagcg aaagcgcaac gatggtgtat aacgaaagag agttcgtaaa
1981 cagaaagcta caccatattg cgatgcacgg accagccctg aacaccgacg aagagtcgta
2041 tgagctggtg agggcagaga ggacagaaca cgagtacgtc tacgacgtgg atcagagaag
2101 atgctgtaag aaggaagaag ccgcaggact ggtactggtg ggcgacttga ctaatccgcc
2161 ctaccacgaa ttcgcatatg aagggctaaa aatccgccct gcctgcccat acaaaattgc
2221 agtcatagga gtcttcggag taccgggatc tggcaagtca gctattatca agaacctagt
2281 taccaggcag gacctggtga ctagcggaaa gaaagaaaac tgccaagaaa tcaccaccga
2341 cgtgatgaga cagagaggtc tagagatatc tgcacgtacg gttgactcgc tgctcttgaa
2401 tggatgcaac agaccagtcg acgtgttgta cgtagacgag gcgtttgcgt gccactctgg
2461 aacgctactt gctttgatcg ccttggtgag accaaggcag aaagttgtac tttgtggtga
2521 cccgaagcag tgcggcttct tcaatatgat gcagatgaaa gtcaactata atcacaacat
2581 ctgcacccaa gtgtaccaca aaagtatctc caggcggtgt acactgcctg tgaccgccat
2641 tgtgtcatcg ttgcattacg aaggcaaaat gcgcactacg aatgagtaca acaagccgat
2701 tgtagtggac actacaggct caacaaaacc tgaccctgga gacctcgtgt taacgtgctt
2761 cagagggtgg gttaaacaac tgcaaattga ctatcgtgga tacgaggtca tgacagcagc
2821 cgcatcccaa gggttaacca gaaaaggagt ttacgcagtt agacaaaaag ttaatgaaaa
2881 cccgctctat gcatcaacgt cagagcacgt caacgtactc ctaacgcgta cggaaggtaa
2941 actggtatgg aagacacttt ccggcgaccc gtggataaag acgctgcaga acccaccgaa
3001 aggaaacttc aaagcaacta ttaaggagtg ggaggtggag catgcatcaa taatggcggg
3061 catctgcagt caccaaatga ccttcgatac attccaaaat aaagccaacg tttgttgggc
3121 taagagcttg gtccctatcc tcgaaacagc ggggataaaa ctaaatgata ggcagtggtc
3181 tcagataatt caagccttca aagaagacaa agcatactca cctgaagtag ccctgaatga
3241 aatatgtacg cgcatgtatg ggtggatct agacagcggg ctattttcta aaccgttggt
3301 gtctgtgtat tacgcggata accactggga taataggcct ggagggaaaa tgttcggatt
3361 taaccccgag gcagcatcca ttctagaaag aaagtatcca ttcacaaaag ggaagtggaa
3421 catcaacaag cagatctgcg tgactaccag gaggatagaa gactttaacc ctaccaccaa
3481 catcataccg gccaacagga gactaccaca ctcattagtg gccgaacacc gcccagtaaa
```

Figure 27 continued

```
3541 aggggaaaga atggaatggc tggttaacaa gataaacggc caccacgtgc tcctggtcag
3601 tggctataac cttgcactgc ctactaagag agtcacttgg gtagcgccgt taggtgtccg
3661 cggagcggac tacacataca acctagagtt gggtctgcca gcaacgcttg gtaggtatga
3721 cctagtggtc ataaacatcc acacaccttt tcgcatacac cattaccaac agtgcgtcga
3781 ccacgcaatg aaactgcaaa tgctcggggg tgactcattg agactgctca aaccgggcgg
3841 ctctctattg atcagagcat atggttacgc agatagaacc agtgaacgag tcatctgcgt
3901 attgggacgc aagtttagat cgtctagagc gttgaaacca ccatgtgtca ccagcaacac
3961 tgagatgttt ttcctattca gcaactttga caatggcaga aggaatttca caactcatgt
4021 catgaacaat caactgaatg cagccttcgt aggacaggtc acccgagcag gatgtgcacc
4081 gtcgtaccgg gtaaaacgca tggacatcgc gaagaacgat gaagagtgcg tagtcaacgc
4141 cgctaaccct cgcgggttac cgggtggcgg tgtttgcaag gcagtataca aaaaatggcc
4201 ggagtccttt aagaacagtg caacaccagt gggaaccgca aaaacagtta tgtgcggtac
4261 gtatccagta atccacgctg ttggaccaaa cttctctaat tattcggagt ctgaaggga
4321 ccgggaattg gcagctgcct atcgagaagt cgcaaaggaa gtaactaggc tgggagtaaa
4381 tagtgtagct atacctctcc tctccacagg tgtatactca ggagggaaag acaggctgac
4441 ccagtcactg aaccacctct ttacagccat ggactcgacg gatgcagacg tggtcatcta
4501 ctgccgcgac aaagaatggg agaagaaaat atctgaggcc atacagatgc ggacccaagt
4561 agagctgctg gatgagcaca tctccataga ctgcgatatt gttcgcgtgc accctgacag
4621 cagcttggca ggcagaaaag gatacagcac cacggaaggc gcactgtact catatctaga
4681 agggacccgt tttcatcaga cggctgtgga tatggcggag atacatacta tgtggccaaa
4741 gcaaacagag gccaatgagc aagtctgcct atatgccctg gggggaaagta ttgaatcgat
4801 caggcagaaa tgcccggtgg atgatgcaga cgcatcatct ccccccaaaa ctgtcccgtg
4861 cctttgccgt tacgctatga ctccagaacg cgtcacccgg cttcgcatga accacgtcac
4921 aagcataatt gtgtgttctt cgtttcccct cccaaagtac aaaatagaag gagtgcaaaa
4981 agtcaaatgc tctaaggtaa tgctatttga ccacaacgtg ccatcgcgcg taagtccaag
5041 ggaatataga tcttcccagg agtctgcaca ggaggcgagt acaatcacgt cactgacgca
5101 tagtcaattc gacctaagcg ttgatggcga gatactgccc gtcccgtcag acctggatgc
5161 tgacgcccca gccctagaac cagcactaga cgacggggcg acacacacgc tgccatccac
5221 aaccggaaac cttgcggccg tgtctgattg ggtaatgagc accgtacctg tcgcgccgcc
5281 cagaagaagg cgagggagaa acctgactgt gacatgtgac gagagagaag ggaatataac
5341 acccatggct agcgtccgat tctttagggc agagctgtgt ccggtcgtac aagaaacagc
5401 ggagacgcgt gacacagcaa tgtctcttca ggcaccaccg agtaccgcca cggaaccgaa
5461 tcatccgccg atctccttcg gagcatcaag cgagacgttc cccattacat ttggggactt
5521 caacgaagga gaaatcgaaa gcttgtcttc tgagctacta actttcggag acttcttacc
5581 aggagaagtg gatgacttga cagacagcga ctggtccacg tgctcagaca cggacgacga
5641 gttaagacta gacagggcag gtgggtatat attctcgtcg gacaccggtc caggtcattt
5701 acaacagaag tcagtacgcc agtcagtgct gccggtgaac accctggagg aagtccacga
5761 ggagaagtgt tacccaccta agctggatga agcaaaggag caactattac ttaagaaact
5821 ccaggagagt gcatccatgg ccaacagaag caggtatcag tcgcgcaaag tagaaaacat
5881 gaaagcagca atcatccaga gactaaagag aggctgtaga ctatacttaa tgtcagagac
5941 cccaaaagtc cctacttacc ggactacata tccggcgcct gtgtactcgc ctccgatcaa
6001 cgtccgattg tccaatcccg agtccgcagt ggcagcatgc aatgagttct tagctagaaa
6061 ctatccaact gtctcatcat accaaattac cgacgagtat gatgcatatc tagacatggt
6121 ggacgggtcg gagagttgcc tggaccgagc gacattcaat ccgtcaaaac tcaggagcta
6181 cccgaaacag cacgcttacc acgcgccctc catcagaagc gctgtaccgt ccccattcca
6241 gaacacacta cagaatgtac tggcagcagc cacgaaaaga aactgcaacg tcacacagat
6301 gagggaatta cccactttgg actcagcagt attcaacgtg gagtgtttca aaaaattcgc
6361 atgcaaccaa gaatactggg aagaatttgc tgccagccct attaggataa caactgagaa
6421 tttagcaacc tatgttacta aactaaaagg gccaaaagca gcagcgctat tcgcaaaaac
6481 ccataatcta ctgccactac aggaagtacc aatggatagg ttcacagtag atatgaaaag
6541 ggacgtaaag gtgactcctg gtacaaagca tacagaggaa agacctaagg tgcaggttat
6601 acaggcggct gaacccttgg cgacagcata cctatgtggg attcacagag agctggttag
6661 gaggctgaac gccgtcctcc tacccaatgt acatacacta tttgacatgt ctgccgagga
6721 tttcgatgcc atcatagccg cacactttaa gccaggagac actgttttgg aaacggacat
6781 agcctccttt gataagagcc aagatgattc acttgcgctt actgctttga tgctgttaga
6841 ggatttaggg gtggatcact ccctgctgga cttgatagag gctgctttcg gagagatttc
6901 cagctgtcac ctaccgacag gtacgcgctt caagttcggc gccatgatga aatcaggtat
6961 gttcctaact ctgttcgtca acacattgtt aaacatcacc atcgccagcc gagtgctgga
7021 agatcgtctg acaaaatccg cgtgcgcggc cttcatcggc gacgacaaca taatacatgg
7081 agtcgtctcc gatgaattga tggcagccag atgtgccact tggatgaaca tggaagtgaa
7141 gatcatagat gcagttgtat ccttgaaagc cccttacttt tgtggagggt ttatactgca
```

Figure 27 continued

```
 7201 cgatactgtg acaggaacag cttgcagagt ggcagacccg ctaaaaaggc tttttaaact
 7261 gggcaaaccg ctagcggcag gtgacgaaca agatgaagat agaagacgag cgctggctga
 7321 cgaagtgatc agatggcaac gaacagggct aattgatgag ctggagaaag cggtatactc
 7381 taggtacgaa gtgcagggta tatcagttgt ggtaatgtcc atggccacct ttgcaagctc
 7441 cagatccaac ttcgagaagc tcagaggacc cgtcataact ttgtacggcg gtcctaaata
 7501 ggtacgcact acagctacct attttgcaga agccgacagc aagtatctaa acactaatca
 7561 gctacaatgg agttcatccc aacccaaact ttttacaata ggaggtacca gcctcgaccc
 7621 tggactccgc gccctactat ccaagtcatc aggcccagac cgcgccctca gaggcaagct
 7681 gggcaacttg cccagctgat ctcagcagtt aataaactga caatgcgcgc ggtaccacaa
 7741 cagaagccac gcaggaatcg gaagaataag aagcaaaagc aaaaacaaca ggcgccacaa
 7801 aacaacacaa atcaaaagaa gcagccacct aaaaagaaac cggctcaaaa gaaaaagaag
 7861 ccgggccgca gagagaggat gtgcatgaaa atcgaaaatg attgtatttt cgaagtcaag
 7921 cacgaaggta aggtaacagg ttacgcgtgc ctggtggggg acaaagtaat gaaaccagca
 7981 cacgtaaagg ggaccatcga taacgcggac ctggccaaac tggcctttaa gcggtcatct
 8041 aagtatgacc ttgaatgcgc gcagataccc gtgcacatga agtccgacgc ttcgaagttc
 8101 acccatgaga aaccggaggg gtactacaac tggcaccacg gagcagtaca gtactcagga
 8161 ggccggttca ccatccctac aggtgctggc aaaccagggg acagcggcag accgatcttc
 8221 gacaacaagg gacgcgtggt ggccatagtc ttaggaggag ctaatgaagg agcccgtaca
 8281 gccctctcgg tggtgacctg gaataaagac attgtcacta aaatcacccc cgaggggggcc
 8341 gaagagtgga gtcttgccat cccagttatg tgcctgttgg caaacaccac gttcccctgc
 8401 tcccagcccc cttgcacgcc ctgctgctac gaaaaggaac cggaggaaac cctacgcatg
 8461 cttgaggaca acgtcatgag acctgggtac tatcagctgc tacaagcatc cttaacatgt
 8521 tctccccacc gccagcgacg cagcaccaag gacaacttca atgtctataa agccacaaga
 8581 ccatacttag ctcactgtcc cgactgtgga gaagggcact cgtgccatag tcccgtagca
 8641 ctagaacgca tcagaaatga agcgacagac gggacgctga aaatccaggt ctccttgcaa
 8701 atcggaataa agacggatga cagccacgat tggaccaagc tgcgttatat ggacaaccac
 8761 atgccagcag acgcagagag ggcggggcta tttgtaagaa catcagcacc gtgtacgatt
 8821 actggaacaa tgggacactt catcctggcc cgatgtccaa aaggggaaac tctgacggtg
 8881 ggattcactg acagtaggaa gattagtcac tcatgtacgc acccatttca ccacgaccct
 8941 cctgtgatag gtcgggaaaa attccattcc cgaccgcagc acggtaaaga gctaccttgc
 9001 agcacgtacg tgcagagcac cgccgcaact accgaggaga tagaggtaca catgccccca
 9061 gacacccctg atcgcacatt aatgtcacaa cagtccggca acgtaaagat cacagtcaat
 9121 ggccagacgg tgcggtacaa gtgtaattgc ggtggctcaa atgaaggact aacaactaca
 9181 gacaaagtga ttaataactg caaggttgat caatgtcatg ccgcggtcac caatcacaaa
 9241 aagtggcagt ataactcccc tctggtcccg cgtaatgctg aacttgggga ccgaaaagga
 9301 aaaattcaca tcccgtttcc gctggcaaat gtaacatgca gggtgcctaa agcaaggaac
 9361 cccaccgtga cgtacgggaa aaaccaagtc atcatgctac tgtatcctga ccacccaaca
 9421 ctcctgtcct accggaatat gggagaagaa ccaaactatc aagaagagtg ggtgatgcat
 9481 aagaaggaag tcgtgctaac cgtgccgact gaagggctcg aggtcacgtg gggcaacaac
 9541 gagccgtata agtattggcc gcagttatct acaaacggta cagcccatgg ccacccgcat
 9601 gagataattc tgtattatta tgagctgtac cccactatga ctgtagtagt tgtgtcagtg
 9661 gccacgttca tactcctgtc gatggtgggt atggcagcgg ggatgtgcat gtgtgcacga
 9721 cgcagatgca tcacaccgta tgaactgaca ccaggagcta ccgtcccttt cctgcttagc
 9781 ctaatatgct gcatcagaac agctaaagcg gccacatacc aagaggctgc gatatacctg
 9841 tggaacgagc agcaaccttt gttttggcta caagccctta ttccgctggc agccctgatt
 9901 gttctatgca actgtctgag actcttacca tgctgctgta aaacgttggc tttttagcc
 9961 gtaatgagcg tcggtgccca cactgtgagc gcgtacgaac acgtaacagt gatcccgaac
10021 acggtgggag taccgtataa gactctagtc aatagacctg gctacagccc catggtattg
10081 gagatggaac tactgtcagt cactttggag ccaacactat cgcttgatta catcacgtgc
10141 gagtacaaaa ccgtcatccc gtctccgtac gtgaagtgct gcggtacagc agagtgcaag
10201 gacaaaaacc tacctgacta cagctgtaag gtcttcaccg gcgtctaccc atttatgtgg
10261 ggcggcgcct actgcttctg cgacgctgaa aacacgcagt tgagcgaagc acacgtggag
10321 aagtccgaat catgcaaaac agaatttgca tcagcataca gggctcatac cgcatctgca
10381 tcagctaagc tccgcgtcct ttaccaagga aataacatca ctgtaactgc ctatgcaaac
10441 ggcgaccatg ccgtcacagt taaggacgcc aaattcattg tggggccaat gtcttcagcc
10501 tggacacctt tcgacaacaa aattgtggtg tacaaaggtg acgtctataa catggactac
10561 ccgccctttg gcgcaggaag accaggacaa tttggcgata tccaaagtcg cacacctgag
10621 agtaaagacg tctatgctaa tacacaactg gtactgcaga gaccggctgt gggtacggta
10681 cacgtgccat actctcaggc accatctggc tttaagtatt ggctaaaaga acgcggggcg
10741 tcgctgcagc acacagcacc atttggctgc caaatagcaa caaacccggt aagagcggtg
10801 aactgcgccg tagggaacat gcccatctcc atcgacatac cggaagcggc cttcactagg
```

Figure 27 continued

```
10861 gtcgtcgacg cgccctcttt aacggacatg tcgtgcgagg taccagcctg cacccattcc
10921 tcagactttg gggcgtcgc cattattaaa tatgcagcca gcaagaaagg caagtgtgcg
10981 gtgcattcga tgactaacgc cgtcactatt cgggaagctg agatagaagt tgaagggaat
11041 tctcagctgc aaatctcttt ctcgacggcc ttagccagcg ccgaattccg cgtacaagtc
11101 tgttctacac aagtacactg tgcagccgag tgccaccccc cgaaggacca catagtcaac
11161 tacccggcgt cacataccac cctcggggtc caggacatct ccgctacggc gatgtcatgg
11221 gtgcagaaga tcacgggagg tgtgggactg gttgttgctg ttgccgcact gattctaatc
11281 gtggtgctat gcgtgtcgtt cagcaggcac taacttgaca attaagtatg aaggtatatg
11341 tgtcccctaa gagacacact gtacatagca aataatctat agatcaaagg gctacgcaac
11401 ccctgaatag taacaaaata caaaatcact aaaaattata aaaacagaaa aatacataaa
11461 taggtatacg tgtcccctaa gagacacatt gtatgtaggt gataagtata gatcaaaggg
11521 ccgaataacc cctgaatagt aacaaaatat gaaaatcaat aaaaatcata aaatagaaaa
11581 accataaaca gaagtagttc aaagggctat aaaacccctg aatagtaaca aaacataaaa
11641 ttaataaaaa tcaaatgaat accataattg gcaaacggaa gagatgtagg tacttaagct
11701 tcctaaaagc agccgaactc actttgagaa gtaggcatag cataccgaac tcttccacga
11761 ttctccgaac ccacagggac gtaggagatg ttattttgtt tttaatattt caaaaaaaaa
11821 aaaaaaaaaa aaaaaaaaaa aaaaaaaaaa agcggccgct taattaatcg aggggaatta
11881 attcttgaag acgaaagggc caggtggcac ttttcgggga aatgtgcgcg gaacccctat
11941 ttgtttattt ttctaaatac attcaaatat gtatccgctc atgagacaat aaccctgata
12001 aatgcttcaa taatattgaa aaaggaagag tatgagtatt caacatttcc gtgtcgccct
12061 tattcccttt tttgcggcat tttgccttcc tgtttttgct cacccagaaa cgctggtgaa
12121 agtaaaagat gctgaagatc agttgggtgc acgagtgggt tacatcgaac tggatctcaa
12181 cagcggtaag atccttgaga gttttcgccc cgaagaacgt tttccaatga tgagcacttt
12241 taaagttctg ctatgtggcg cggtattatc ccgtgttgac gccgggcaag agcaactcgg
12301 tcgccgcata cactattctc agaatgactt ggttgagtac tcaccagtca cagaaaagca
12361 tcttacggat ggcatgacag taagagaatt atgcagtgct gccataacca tgagtgataa
12421 cactgcggcc aacttacttc tgacaacgat cggaggaccg aaggagctaa ccgctttttt
12481 gcacaacatg ggggatcatg taactcgcct tgatcgttgg gaaccggagc tgaatgaagc
12541 cataccaaac gacgagcgtg acaccacgat gcctgtagca atggcaacaa cgttgcgcaa
12601 actattaact ggcgaactac ttactctagc ttcccggcaa caattaatag actggatgga
12661 ggcggataaa gttgcaggac cacttctgcg ctcggccctt ccggctggct ggtttattgc
12721 tgataaatct ggagccggtg agcgtgggtc tcgcggtatc attgcagcac tggggccaga
12781 tggtaagccc tcccgtatcg tagttatcta cacgacgggg agtcaggcaa ctatggatga
12841 acgaaataga cagatcgctg agataggtgc ctcactgatt aagcattggt aactgtcaga
12901 ccaagtttac tcatatatac tttagattga tttaaaactt catttttaat ttaaaaggat
12961 ctaggtgaag atcctttttg ataatctcat gaccaaaatc ccttaacgtg agttttcgtt
13021 ccactgagcg tcagaccccg tagaaaagat caaaggatct tcttgagatc cttttttct
13081 gcgcgtaatc tgctgcttgc aaacaaaaaa accaccgcta ccagcggtgg tttgtttgcc
13141 ggatcaagag ctaccaactc tttttccgaa ggtaactggc ttcagcagag cgcagatacc
13201 aaatactgtc cttctagtgt agccgtagtt aggccaccac ttcaagaact ctgtagcacc
13261 gcctacatac ctcgctctgc taatcctgtt accagtggct gctgccagtg gcgataagtc
13321 gtgtcttacc gggttggact caagacgata gttaccggat aaggcgcagc ggtcgggctg
13381 aacggggggt tcgtgcacac agcccagctt ggagcgaacg acctacaccg aactgagata
13441 cctacagcgt gagcattgag aaagcgccac gcttcccgaa gggagaaagg cggacaggta
13501 tccggtaagc ggcagggtcg gaacaggaga gcgcacgagg gagcttccag ggggaaacgc
13561 ctggtatctt tatagtcctg tcgggtttcg ccacctctga cttgagcgtc gatttttgtg
13621 atgctcgtca ggggggcgga gcctatggaa aaacgccagc aacgcgagct cgtatggaca
13681 tattgtcgtt agaacgcggc tacaattaat acataacctt atgtatcata cacaatcgat
13741 ttaggtgaca ctatag
```

Figure 28

```
   1 atggctgcgt gagacacacg tagcctacca gtttcttact gctctactct gcttagcaag
  61 agacttgaga acccatcatg gatcccgtgt acgtggacat agacgccgac agcgcctttt
 121 taaaggccct gcagcgtgcg taccccatgt ttgaggtgga accaaggcag gtcacaccga
 181 atgaccatgc caatgctaga gcattctcgc atctagctat aaaactaata gagcaggaaa
 241 ttgatcccga ctcaaccatc ctggacatag gcagcgcgcc agcaaggagg atgatgtcgg
 301 ataggaagta ccactgcgtt tgccctatgc gcagcgcaga agaccctgag agactcgcca
 361 actacgcgag aaaactagca tctgccgcag gaaaagtctt ggacagaaac atctccgaaa
 421 aaattggaga tctacaagca gtaatggctg taccagacgc agaaacgccc acattctgct
 481 tgcacactga cgtctcatgt agacaaaggg cggacgtcgc tatataccag gatgtctacg
 541 ccgtgcatgc accaacatcg ctgtaccacc aggcgattaa aggagtccgt gtagcatact
 601 ggataggstt tgatacaacc ccgttcatgt ataatgccat ggcaggtgca tacccctcgt
 661 actcgacaaa ctgggcagat gagcaggtgc tgaaggcaaa gaacatagga ttatgttcaa
 721 cagacctgac ggaaggtaga cgaggtaaat tgtctatcat gagaggaaaa aagatgaagc
 781 catgtgaccg cgtactgttc tcagtcgggt caacgcttta cccggagagc cgtaagcttc
 841 ttaagagttg gcacttacct tcagtgttcc atctaaaagg gaagctcagc ttcacgtgcc
 901 gctgtgatac agtggtttcg tgtgaaggct atgtcgttaa gagaataacg attagcccgg
 961 gcctctacgg taaaaccaca gggtacgcag taacccacca tgcagacgga ttcctaatgt
1021 gcaaaacaac cgatacggta gatggcgaga gagtgtcatt ttcggtatgc acgtacgtac
1081 ccgcaaccat ttgtgatcaa atgacaggta ttcttgccac ggaggttaca ccggaggatg
1141 cacagaagct gctggtggga ctgaaccaga ggatagtggt caatggcaga acgcagagga
1201 acacgaacac aatgaagaat tacttgcttc ctgtagttgc ccaagccctc agtaagtggg
1261 caaaggaatg ccggaaagat atggaagatg aaaaactttt gggcatcaga gaaaggacac
1321 tgacatgctg ctgcctttgg gcgttcaaga agcagaagac acacacggtc tacaagaggc
1381 ctgacactca gtcaattcag aaagtcccag ccgaatttga cagctttgtg gtaccaagtc
1441 tgtggtcatc tggactgtcg atcccgctac ggaccagaat caagtggctg ctaagcaaag
1501 tgccaaagac tgatttgatc ccttacagcg gtgacgccaa agaagcccgc gacgctgaaa
1561 aagaagcaga agaagaacga gaagcggagc taactcgcga ggcactacca ccactacagg
1621 cggcacagga cgacgtccag gtcgaaattg acgtggaaca gctcgaagac agagctgggg
1681 caggaataat tgaaactcca agaggagcta tcaaagtcac tgcccaacca acagaccacg
1741 tcgtgggaga gtacttggta ctttccccgc agaccgtgtt acgaagccag aagctcagcc
1801 tgatccacgc attggcggaa caagtgaaga catgcacaca cagcggacgg gcaggaaggt
1861 acgcggtcga agcatatgac ggcagaatcc ttgtgccctc aggctatgca atatcacctg
1921 aagacttcca gagcctgagc gaaagtgcga cgatggtgta caacgaaagg gagttcgtaa
1981 ataggaaatt acaccatatc gcgttgcacg gaccagccct gaacactgac gaggagtcgt
2041 acgagctggt aagggcagaa aggacagagc atgagtacgt ctatgatgtg gaccaaagaa
2101 ggtgctgcaa gaaagaggag gcagccgggc tggtactggt cggcgacttg accaacccgc
2161 cctaccatga gttcgcatat gaagggctga gaatccgccc cgcctgccca tacaagaccg
2221 cagtaatagg ggtctttgga gtgccaggat ccggcaaatc agcaatcatt aagaacctag
2281 ttaccaggca agacctagtg accagtggaa agaaagaaaa ctgccaagaa atctccaccg
2341 acgtgatgcg acagaggaac ctggagatat ctgcacgcac ggtcgactca ctgctcttga
2401 acggatgcaa tagaccagtc gacgtgttgt acgtcgacga agcttttgcg tgccattctg
2461 gcacgctact tgctctgata gccttggtga gaccgaggca gaaagtcgtg ctatgcggtg
2521 atccgaaaca gtgcggcttc ttcaatatga tgcagatgaa agttaactac aaccataaca
2581 tctgcaccca agtgtaccat aaaagtattt ccaggcggtg tacactgcct gtgactgcca
2641 ttgtgtcctc gttgcattac gaaggcaaaa tgcgcacaac aaatgagtac aacaagccaa
2701 ttgtagtgga tactacaggc tcgacaaaac ccgaccccgg agaccttgtg ctaacatgtt
2761 tcagagggtg ggttaagcaa ctgcaaattg actatcgtgg acacgaggtc atgacagcag
2821 ctgcatctca ggggctaacc agaaaagggg tctatgccgt caggcaaaaa gttaatgaaa
2881 acccccttta cgcatcaaca tcagagcacg tgaacgtgct actgacgcgt acggaaggca
2941 aactagtatg gaagacactt tctggagacc catggataaa gacactgcag aacccgccga
3001 aaggaaattt taaagcaaca attaaggaat gggaagtgga acatgcttca ataatggcgg
3061 gtatctgtaa ccaccaagtg acctttgaca cgttccagaa taaagccaat gtctgctggg
3121 cgaagagctt agtccccatc ctagaaacag cagggataaa attaaacgac aggcagtggt
3181 cccagataat ccaggctttt aaagaagaca gagcatactc acccgaggtg gccctgaatg
3241 agatatgcac gcgcatgtac ggggtagacc tggacagcgg actgttctct aaaccactgg
3301 tgtccgtgca tcatgcggat aatcactggg acaacaggcc gggagggaag atgttcggat
3361 tcaaccccga agcggcgtcc atactggaga ggaaataccc gtttacaaaa gggaagtgga
3421 ataccaacaa gcaaatctgt gtgactacta ggaggattga agattttaac ccgaacacca
3481 acattatacc tgccaacagg agattaccgc attcattggt ggccgaacat cgcccggtaa
```

Figure 28 continued

```
3541 aaggggagag gatggaatgg ttggtcaaca aaataaatgg ccaccatgtg ctcctggtca
3601 gcggctacaa cctcgttctg cccactaaga gagtcacctg ggtggcgccg ctgggcattc
3661 ggggagctga ctacacatac aacctagagt taggcctacc agcaacgctc ggtagatatg
3721 acctagtgat tataaacatc cacacaccct ttcgcataca tcattaccaa cagtgcgtgg
3781 atcacgcaat gaagctgcag atgctcggag gagactccct gagactgctc aagccgggtg
3841 gttcattact gatcagggca tacggctacg cagacagaac aagcgaacga gtagtctgcg
3901 tattgggacg caagtttcga tcatccagag cgttgaaacc gccgtgcgtc actagcaaca
3961 ccgagatgtt tttcttgttc agcaactttg ataacggcag aaggaacttt acgacgcacg
4021 taatgaacaa ccagctgaat gctgcttttg ttggtcaggc cacccgagca gggtgcgcac
4081 cgtcgtaccg ggttaaacgc atggacatcg caaagaacga tgaagagtgt gtagtcaacg
4141 ccgccaaccc tcgtgggcta ccaggcgatg gcgtctgtaa agcagtatac aaaaaatggc
4201 cggagtcctt caagaacagt gcaacaccag tgggaaccgc aaagacagtc atgtgcggta
4261 catacccggt aatccatgca gtaggaccta atttctcaaa ttactctgag tccgaaggag
4321 accgggaatt ggcagctgct taccgagaag tcgctaagga ggtgactaga ctaggagtaa
4381 acagcgtagc tataccgctc ctttccaccg gtgtgtactc tggagggaaa gacaggctga
4441 ctcagtcact aaaccacctt tttacagcat tagactcaac tgatgcagat gtggttatct
4501 actgccgcga caaggagtgg gagaagaaaa tagctgaggc catacaaatg aggacccaag
4561 tggaattact agacgaacac atctctgtag actgcgatat catccgagtg caccctgaca
4621 gcagtttggc aggtagaaaa gggtacagca ctacagaagg ttcactgtac tcctacttgg
4681 aagggacacg gttccatcag acggcagtgg acatggcaga agtatacacc atgtggccaa
4741 agcagacgga ggctaatgaa caagtttgct tgtacgcatt gggggaaagt atagaatcaa
4801 tcaggcaaaa gtgcccagtg gatgacgcag atgcatcgtc gcccccaaaa accgtcccgt
4861 gcctctgccg ttatgccatg acacccgaac gagtcaccag gcttcgtatg aaccatgtca
4921 caagcataat agtatgctca tcattccccc ttccaaagta taaaatagaa ggagtgcaga
4981 aagtcaagtg ttctaaagtg atgctgttcg accataacgt gccatcacgc gttagtccaa
5041 gggaatataa atcgcctcag gagaccgcac aagaagtaag ttcgaccacg tcactgacgc
5101 acagccaatt cgaccttagc gttgacggtg aggaactgcc cgctccgtct gacttggaag
5161 ctgacgctcc gattccggaa ccaacaccag acgacagagc ggtacttact ttgcctccca
5221 cgattgataa tttttcggct gtgtcagact gggtaatgaa taccgcgcca gtcgcaccac
5281 ccagaagaag acgtgggaaa aacttgaatg tcacctgcga cgagagagaa gggaacgtac
5341 ttcccatggc tagcgttcgg ttcttcagag cggatctgca ctccatcgta caggaaacgg
5401 cagagatacg cgatacggcc gcgtccctcc aggcgcccct gagtgtcgct acagaaccga
5461 atcaactgcc gatctcattt ggagcaccaa acgagacttt ccccataacg ttcggggatt
5521 ttgatgaagg ggagattgaa agcttgtcct ctgagttact gacctttggg gacttctcgc
5581 cgggcgaagt ggatgacctg acagacagcg actggtccac gtgttcagac acggacgacg
5641 aattatgact agataggca ggtgggtaca tattctcatc tgacaccggc cccggccacc
5701 tgcaacagag gtctgtccgt cagacagtac tgccggtaaa taccttggag gaagttcagg
5761 aggagaaatg ttacccacct aagttggatg aagtgaaaga gcagttgtta cttaagaaac
5821 tccaggaaag tgcgtccatg gctaacagaa gcaggtacca atcccgcaaa gtagagaaca
5881 tgaaagcaac aatagtccaa aggctgaagg gtggttgcaa actttattta atgtcggaga
5941 ccccgaaagt tcctacctac cgaactacat atccggcacc agtgtactca cccccaatca
6001 atatccgact gtccaacccc gagtctgctg tggcagcgtg caatgagttc ctagcaagga
6061 actatccgac agttgcgtcg taccaaatca ccgatgagta cgatgcatac ctagacatgg
6121 tggacgggtc ggaaagttgc cttgaccggg cgacgttcaa cccatcaaag cttagaagtt
6181 atccaaaaca gcactcctac catgcaccca caatcagaag tgccgtacct tccccgttcc
6241 agaacacgct gcagaacgta ctggctgctg ccacgaaaag aaattgcaac gtcacacaga
6301 tgagagaact gcctactttg gattcagcgg tatttaatgt tgagtgcttt aaaaaatttg
6361 cgtgcaatca agaatactgg aaggaatttg ccgccagccc tattaggata acgactgaga
6421 acttgacaac ttatgtcaca aaactaaaag gaccaaaagc agcagcactg tttgccaaga
6481 cacataacct gctaccactg caggaggtgc cgatggacag gtttactgta gacatgaaaa
6541 gggacgtgaa ggtgactccg ggacgaagc acactgagga aagacctaaa gtgcaggtca
6601 tacaggcagc cgaacctttg gcaacagcat atctgtgtgg gatccacaga gagttggtca
6661 gaaggctgaa tgcagtcctt ctacctaatg tacacacgct gtttgacatg tctgccgagg
6721 actttgacgc cattattgcc gcgcacttca agccggggga cgccgtattg gaaaccgata
6781 tagcctcctt tgacaagagc caagacgact cattggcgct cactgctcta atgttgctag
6841 aggatttggg ggtggatcat cccctgttgg acttgataga ggctgccttc ggggagatct
6901 ccagctgcca cctaccgacg ggcacccgtt ttaagttcgg cgccatgatg aagtctggta
6961 tgttcctaac cctgttcgtc aacacactgc taaacatcac catagccagc cgagtgctgg
7021 aggaccgctt gacaaggtct gcgtgcgcgg ccttcatcgg cgacgacaat ataatacatg
7081 gggttgtctc tgacgaactg atggcagcaa ggtgtgctac atggatgaac atggaagtga
7141 agatcataga tgcggtcgtg tctcagaaag ccccgtactt ctgcggaggg tttatactgt
```

Figure 28 continued

```
7201 atgacacagt agcaggcacg gcctgcagag tggcagaccc gctaaagcgg ctgttcaagc
7261 tgggcaaacc gctggcagcg ggagatgaac aagacgacga cagaagacgt gcactggctg
7321 acgaagtggt tagatggcaa cgaacaggac taactgatga gctagaaaaa gcggtacact
7381 ccaggtatga agtgcagggc atatctgtcg tggtaatctc tatggccacc tttgcaagct
7441 ctagatctaa ctttgagaag ctcagaggac ccgtcgtaac cctgtacggt ggtcctaaat
7501 aggtacgcac tacagctacc tatttcgtca gaaaccaatc gcagctactt gcatacctac
7561 cagctacaat ggagttcatc ccgacgcaaa ctttctataa cagaaggtac caaccccgac
7621 cctgggcccc acgccctaca attcaagtaa ttagacctag accacgtcca cagaggcagg
7681 ctgggcaact cgcccagctg atctccgcag tcaacaaatt gaccatgcgc gcggtacctc
7741 aacagaagcc tcgcagaaat cggaaaaaca agaagcaaag gcagaagaag caggcgccgc
7801 aaaacgaccc aaagcaaaag aagcaaccac cacaaaagaa gccggctcaa aagaagaaga
7861 aaccaggccg tagggagaga atgtgcatga aaattgaaaa tgattgcatc ttcgaagtca
7921 agcatgaagg caaagtgatg ggctacgcat gcctggtggg ggataaagta atgaaaccag
7981 cacatgtgaa gggaactatc gacaatgccg atctggctaa actggccttt aagcggtcgt
8041 ctaaatacga tcttgaatgt gcacagatac cggtgcacat gaagtctgat gcctcgaagt
8101 ttacccacga gaaacccgag ggtactata actggcatca cggagcagtg cagtattcag
8161 gaggccggtt cactatcccg acgggtgcag gcaagccggg agacagcggc agaccgatct
8221 tcgacaacaa aggacgggtg gtggccatcg tcctaggagg ggccaacgaa ggtgcccgca
8281 cggccctctc cgtggtgacg tggaacaaag acatcgtcac aaaaattacc cctgagggag
8341 ccgaagagtg gagcctcgcc ctcccggtct tgtgcctgtt ggcaaacact acattcccct
8401 gctctcagcc gccttgcaca ccctgctgct acgaaaagga accggaaagc accttgcgca
8461 tgcttgagga caacgtgatg agacccggat actaccagct actaaaagca tcgctgactt
8521 gctctcccca ccgccaaaga cgcagtacta aggacaattt taatgtctat aaagccacaa
8581 gaccatatct agctcattgt cctgactgcg gagaagggca ttcgtgccac agccctatcg
8641 cattggagcg catcagaaat gaagcaacgg acggaacgct gaaaatccag gtctctttgc
8701 agatcgggat aaagacagat gacagccacg attggaccaa gctgcgctat atggatagcc
8761 atacgccagc ggacgcggag cgagccggat tgcttgtaag gacttcagca ccgtgcacga
8821 tcaccgggac catgggacac tttattctcg cccgatgccc gaaaggagag acgctgacag
8881 tgggatttac ggacagcaga aagatcagcc acacatgcac acacccgttc catcatgaac
8941 cacctgtgat aggtagggag aggttccact ctcgaccaca acatggtaaa gagttacctt
9001 gcagcacgta cgtgcagagc accgctgcca ctgctgagga gatagaggtg catatgcccc
9061 cagatactcc tgaccgcacg ctgatgacgc agcagtctgg caacgtgaag atcacagtta
9121 atgggcagac ggtgcggtac aagtgcaact gcggtggctc aaacgaggga ctgacaacca
9181 cagacaaagt gatcaataac tgcaaaattg atcagtgcca tgctgcagtc actaatcaca
9241 agaattggca atacaactcc cctttagtcc cgcgcaacgc tgaactcggg gaccgtaaag
9301 gaaagatcca catcccattc ccattggcaa acgtgacttg cagagtgcca aaagcaagaa
9361 accctacagt aacttacgga aaaaaccaag tcaccatgct gctgtatcct gaccatccga
9421 cactcttgtc ttaccgtaac atgggacagg aaccaaatta ccacgaggag tgggtgacac
9481 acaagaagga ggttaccttg accgtgccta ctgagggtct ggaggtcact tggggcaaca
9541 acgaaccata caagtactgg ccgcagatgt ctacgaacgg tactgctcat ggtcacccac
9601 atgagataat cttgtactat tatgagctgt accccactat gactgtagtc attgtgtcgg
9661 tggcctcgtt cgtgcttctg tcgatggtgg gcacagcagt gggaatgtgt gtgtgcgcac
9721 ggcgcagatg cattacacca tatgaattaa caccaggagc cactgttccc ttcctgctca
9781 gcctgctatg ctgcgtcaga acgaccaagg cggccacata ttacgaggct gcggcatatc
9841 tatggaacga acagcagccc ctgttctggt tgcaggctct tatcccgctg gccgccttga
9901 tcgtcctgtg caactgtctg aaactcttgc catgctgctg taagaccctg gctttttttag
9961 ccgtaatgag catcggtgcc cacactgtga gcgcgtacga acacgtaaca gtgatcccga
10021 acacggtggg agtaccgtat aagactcttg tcaacagacc gggttacagc cccatggtgt
10081 tggagatgga gctacaatca gtcaccttgg aaccaacact gtcacttgac tacatcacgt
10141 gcgagtacaa aactgtcatc ccctccccgt acgtgaagtg ctgtggtaca gcagagtgca
10201 aggacaagag cctaccagac tacagctgca aggtctttac tggagtctac ccatttatgt
10261 ggggcggcgc ctactgcttt tgcgacgccg aaaatacgca attgagcgag gcacatgtag
10321 agaaatctga atcttgcaaa acagagtttg catcggccta cagagcccac accgcatcgg
10381 cgtcggcgaa gctccgcgtc ctttaccaag gaaacaacat taccgtagct gcctacgcta
10441 acggtgacca tgccgtcaca gtaaaggacg ccaagtttgt cgtgggccca atgtcctccg
10501 cctggacacc ttttgacaac aaaatcgtgg tgtacaaagg cgacgtctac aacatggact
10561 acccaccttt tggcgcagga agaccaggac aatttggtga cattcaaagt cgtacaccgg
10621 aaagtaaaga cgtttatgcc aacactcagt tggtactaca gaggccagca gcaggcacgg
10681 tacatgtacc atactctcag gcaccatctg gcttcaagta ttggctgaag gaacgaggag
10741 catcgctaca gcacacggca ccgttcggtt gccagattgc gacaaacccg gtaagagctg
10801 taaattgcgc tgtggggaac ataccaattt ccatcgacat accggatgcg gcctttacta
```

Figure 28 continued

```
10861 gggttgtcga tgcaccctct gtaacggaca tgtcatgcga agtaccagcc tgcactcact
10921 cctccgactt tgggggcgtc gccatcatca aatacacagc tagcaagaaa ggtaaatgtg
10981 cagtacattc gatgaccaac gccgttacca ttcgagaagc cgacgtagaa gtagagggga
11041 actcccagct gcaaatatcc ttctcaacag ccctggcaag cgccgagttt cgcgtgcaag
11101 tgtgctccac acaagtacac tgcgcagccg catgccaccc tccaaaggac cacatagtca
11161 attacccagc atcacacacc acccttgggg tccaggatat atccacaacg gcaatgtctt
11221 gggtgcagaa gattacggga ggagtaggat taattgttgc tgttgctgcc ttaattttaa
11281 ttgtggtgct atgcgtgtcg tttagcaggc actaaaccga tgataaggca cgaaataact
11341 aaatagcaaa agtagaaagt acataaccag gtatatgtgc cccttaagag gcacaatata
11401 tatagctaag cactattaga tcaaagggct atacaacccc tgaatagtaa caaaacacaa
11461 aaaccaataa aaatcataaa aagaaaaatc tcataaacag gtataagtgt cccctaagag
11521 acacattgta tgtaggtagt aagtatagat caaagggcta tattaacccc tgaatagtaa
11581 caaaacacaa aaacaataaa aactacaaaa tagaaaatct ataaacaaaa gtagttcaaa
11641 gggctacaaa acccctgaat agtaacaaaa cataaaatgt aataaaaatt aagtgtgtac
11701 ccaaaagagg tacagtaaga atcagtgaat atcacaattg gcaacgagaa gagacgtagg
11761 tatttaagct tcctaaaagc agccgaactc actttgagac gtaggcatag cataccgaac
11821 tcttccacta ttctccgaac ccacagggac gtaggagatg ttattttgtt tttaatattt
11881 caaaaaaaaa aaaaaaaaaa aaaaaaaaaa aaaaaaaaaa agcggccgct taattaatcg
11941 aggggaatta attcttgaag acgaaagggc caggtggcac ttttcgggga aatgtgcgcg
12001 gaacccctat ttgtttattt ttctaaatac attcaaatat gtatccgctc atgagacaat
12061 aaccctgata aatgcttcaa taatattgaa aaaggaagag tatgagtatt caacatttcc
12121 gtgtcgccct tattcccttt tttgcggcat tttgccttcc tgtttttgct cacccagaaa
12181 cgctggtgaa agtaaaagat gctgaagatc agttgggtgc acgagtgggt tacatcgaac
12241 tggatctcaa cagcggtaag atccttgaga gttttcgccc cgaagaacgt tttccaatga
12301 tgagcacttt taaagttctg ctatgtggcg cggtattatc ccgtgttgac gccgggcaag
12361 agcaactcgg tcgccgcata cactattctc agaatgactt ggttgagtac tcaccagtca
12421 cagaaaagca tcttacggat ggcatgacag taagagaatt atgcagtgct gccataacca
12481 tgagtgataa cactgcggcc aacttacttc tgacaacgat cggaggaccg aaggagctaa
12541 ccgctttttt gcacaacatg ggggatcatg taactcgcct tgatcgttgg gaaccggagc
12601 tgaatgaagc cataccaaac gacgagcgtg acaccacgat gcctgtagca atggcaacaa
12661 cgttgcgcaa actattaact ggcgaactac ttactctagc ttcccggcaa caattaatag
12721 actggatgga ggcggataaa gttgcaggac cacttctgcg ctcggccctt ccggctggct
12781 ggtttattgc tgataaatct ggagccggtg agcgtgggtc tcgcggtatc attgcagcac
12841 tggggccaga tggtaagccc tcccgtatcg tagttatcta cacgacgggg agtcaggcaa
12901 ctatggatga acgaaataga cagatcgctg agataggtgc ctcactgatt aagcattggt
12961 aactgtcaga ccaagtttac tcatatatac tttagattga tttaaaactt catttttaat
13021 ttaaaaggat ctaggtgaag atcctttttg ataatctcat gaccaaaatc ccttaacgtg
13081 agttttcgtt ccactgagcg tcagaccccg tagaaaagat caaaggatct tcttgagatc
13141 cttttttctc gcgcgtaatc tgctgcttgc aaacaaaaaa accaccgcta ccagcggtgg
13201 tttgtttgcc ggatcaagag ctaccaactc tttttccgaa ggtaactggc ttcagcagag
13261 cgcagatacc aaatactgtc cttctagtgt agccgtagtt aggccaccac ttcaagaact
13321 ctgtagcacc gcctacatac ctcgctctgc taatcctgtt accagtggct gctgccagtg
13381 gcgataagtc gtgtcttacc gggttggact caagacgata gttaccggat aaggcgcagc
13441 ggtcgggctg aacggggggt tcgtgcacac agcccagctt ggagcgaacg acctacaccg
13501 aactgagata cctacagcgt gagcattgag aaagcgccac gcttcccgaa gggagaaagg
13561 cggacaggta tccggtaagc ggcagggtcg gaacaggaga gcgcacgagg gagcttccag
13621 ggggaaacgc ctggtatctt tatagtcctg tcgggtttcg ccacctctga cttgagcgtc
13681 gatttttgtg atgctcgtca ggggggcgga gcctatggaa aaacgccagc aacgcgagct
13741 cgtatggaca tattgtcgtt agaacgcggc tacaattaat acataacctt atgtatcata
13801 cacaatcgat ttaggtgaca ctatag
```

Figure 29A

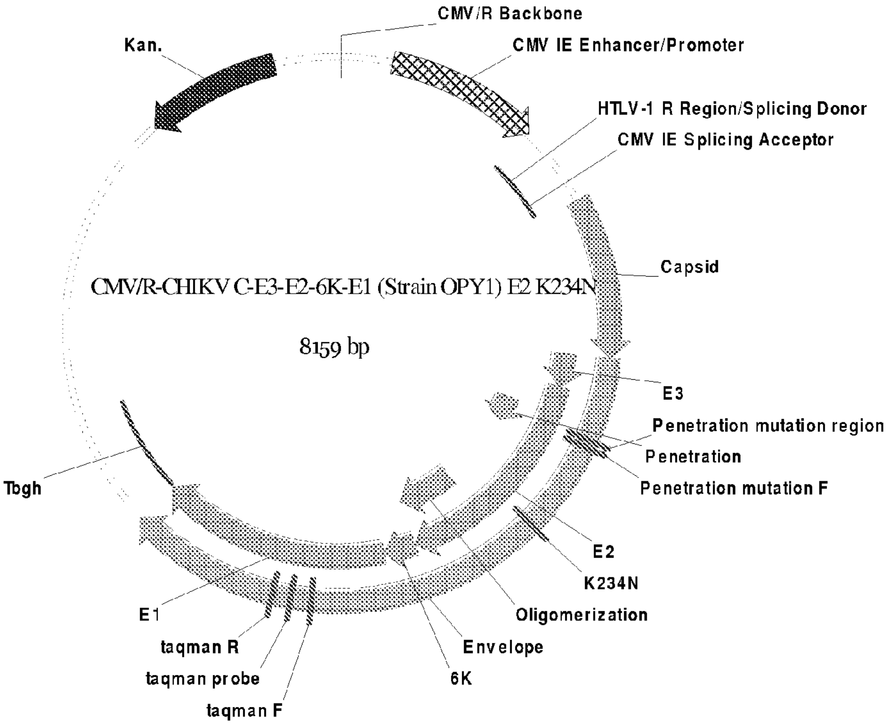

Figure 29B

Sequence of insert atggagttcatcccaacccaaactttttacaataggaggtaccagcctcgaccctggactccgcgccctactatc
caagtcatcaggcccagaccgcgccctcagaggcaagctgggcaacttgcccagctgatctcagcagttaataaa
ctgacaatgcgcgcggtaccacaacagaagccacgcaggaatcggaagaataagaagcaaaagcaaaaacaacag
gcgccacaaaacaacacaaatcaaaagaagcagccacctaaaaagaaaccggctcaaaagaaaaagaagccgggc
cgcagagagaggatgtgcatgaaaatcgaaaatgattgtattttcgaagtcaagcacgaaggtaaggtaacaggt
tacgcgtgcctggtgggggacaaagtaatgaaaccagcacacgtaaaggggaccatcgataacgcggacctggcc
aaactggcctttaagcggtcatctaagtatgaccttgaatgcgcgcagatacccgtgcacatgaagtccgacgct
tcgaagttcacccatgagaaaccggaggggtactacaactggcaccacggagcagtacagtactcaggaggccgg
ttcaccatccctacaggtgctggcaaaccaggggacagcggcagaccgatcttcgacaacaagggacgcgtggtg
gccatagtcttaggaggagctaatgaaggagcccgtacagccctctcggtggtgacctggaataaagacattgtc
actaaaatcacccccgaggggggccgaagagtggagtcttgccatcccagttatgtgcctgttggcaaacaccacg
ttcccctgctcccagccccccttgcacgccctgctgctacgaaaggaaccggaggaaaccctacgcatgcttgag
gacaacgtcatgagacctgggtactatcagctgctacaagcatccttaacatgttctccccaccgccagcgacgc
agcaccaaggacaacttcaatgtctataaagccacaagaccatacttagctcactgtcccgactgtggagaaggg
cactcgtgccatagtcccgtagcactagaacgcatcagaaatgaagcgacagacgggacgctgaaaatccaggtc
tccttgcaaatcggaataaagacggatgacagccacgattggaccaagctgcgttatatggacaaccacatgcca
gcagacgcagagagggcggggctatttgtaagaacatcagcaccgtgtacgattactggaacaatgggacacttc
atcctggcccgatgtccaaaaggggaaactctgacggtgggattcactgacagtaggaagattagtcactcatgt
acgcacccatttcaccacgaccctcctgtgataggtcggaaaaattccattcccgaccgcagcacggtaaagag
ctaccttgcagcacgtacgtgcagagcaccgccgcaactaccgaggagatagaggtacacatgcccccagacacc
cctgatcgcacattaatgtcacaacagtccggcaacgtaaagatcacagtcaatggccagacggtgcggtacaag
tgtaattgcggtggctcaaatgaaggactaacaactacagacaaagtgattaataactgcaaggttgatcaatgt
catgccgcggtcaccaatcacaaaaattggcagtataactcccctctggtcccgcgtaatgctgaacttggggac
cgaaaaggaaaaattcacatcccgtttccgctggcaaatgtaacatgcagggtgcctaaagcaaggaaccccacc

Figure 29B continued gtgacgtacgggaaaaaccaagtcatcatgctactgtatcctgaccacccaacactcctgtcctaccggaatatg
ggagaagaaccaaactatcaagaagagtgggtgatgcataagaaggaagtcgtgctaaccgtgccgactgaaggg
ctcgaggtcacgtggggcaacaacgagccgtataagtattggccgcagttatctacaaacggtacagcccatggc
cacccgcatgagataattctgtattattatgagctgtaccccactatgactgtagtagttgtgtcagtggccacg
ttcatactcctgtcgatggtggtatggcagcggggatgtgcatgtgtgcacgacgcagatgcatcacaccgtat
gaactgacaccaggagctaccgtccctttcctgcttagcctaatatgctgcatcagaacagctaaagcggccaca
taccaagaggctgcgatatacctgtggaacgagcagcaacctttgttttggctacaagcccttattccgctggca
gccctgattgttctatgcaactgtctgagactcttaccatgctgctgtaaaacgttggctttttttagccgtaatg
agcgtcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgcgagtacaaaaccgtcatcccgtctccgtacgtgaagtgctgcggtacagca
gagtgcaaggacaaaaacctacctgactacagctgtaaggtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaataac
atcactgtaactgcctatgcaaacggcgaccatgccgtcacagttaaggacgccaaattcattgtggggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactagggtcgtc
gacgcgccctctttaacggacatgtcgtgcgaggtaccagcctgcacccattcctcagactttgggggcgtcgcc
attattaaatatgcagccagcaagaaaggcaagtgtgcggtgcattcgatgactaacgccgtcactattcggaa
gctgagatagaagttgaagggaattctcagctgcaaatctctttctcgacggccttagccagcgccgaattccgc
gtacaagtctgttctacacaagtacactgtgcagccgagtgccacccccgaaggaccacatagtcaactacccg
gcgtcacataccaccctcggggtccaggacatctccgctacggcgatgtcatgggtgcagaagatcacgggaggt
gtgggactggttgttgctgttgccgcactgattctaatcgtggtgctatgcgtgtcgttcagcaggcac Sequence of vector tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccaacccaaacttttacaataggaggtac
cagcctcgaccctggactccgcgccctactatccaagtcatcaggcccagaccgcgccctcagaggcaagctggg
caacttgcccagctgatctcagcagttaataaactgacaatgcgcgcggtaccacaacagaagccacgcaggaat
cggaagaataagaagcaaaagcaaaaacaacaggcgccacaaaacaacacaaatcaaaagaagcagccacctaaa
aagaaaccggctcaaaagaaaaagaagccgggccgcagagagaggatgtgcatgaaaatcgaaaatgattgtatt
ttcgaagtcaagcacgaaggtaaggtaacaggttacgcgtgcctggtgggggacaaagtaatgaaaccagcacac
gtaaaggggaccatcgataacgcggacctggccaaactggcctttaagcggtcatctaagtatgaccttgaatgc
gcgcagatacccgtgcacatgaagtccgacgcttcgaagttcacccatgagaaaccggaggggtactacaactgg
caccacggagcagtacagtactcaggaggccggttcaccatccctacaggtgctggcaaaccaggggacagcggc
agaccgatcttcgacaacaagggacgcgtggtggccatagtcttaggaggagctaatgaaggagcccgtacagcc
ctctcggtggtgacctggaataaagacattgtcactaaaatcacccccgagggggccgaagagtggagtcttgcc

Figure 29B continued atcccagttatgtgcctgttggcaaacaccacgttcccctgctcccagccccttgcacgccctgctgctacgaa
aaggaaccggaggaaaccctacgcatgcttgaggacaacgtcatgagacctgggtactatcagctgctacaagca
tccttaacatgttctccccaccgccagcgacgcagcaccaaggacaacttcaatgtctataaagccacaagacca
tacttagctcactgtcccgactgtggagaagggcactcgtgccatagtcccgtagcactagaacgcatcagaaat
gaagcgacagacgggacgctgaaaatccaggtctccttgcaaatcggaataaagacggatgacagccacgattgg
accaagctgcgttatatggacaaccacatgccagcagacgcagagagggcggggctatttgtaagaacatcagca
ccgtgtacgattactggaacaatgggacacttcatcctggcccgatgtccaaaaggggaaactctgacggtggga
ttcactgacagtaggaagattagtcactcatgtacgcacccatttcaccacgaccctcctgtgataggtcgggaa
aaattccattcccgaccgcagcacggtaaagagctaccttgcagcacgtacgtgcagagcaccgccgcaactacc
gaggagatagaggtacacatgcccccagacacccctgatcgcacattaatgtcacaacagtccggcaacgtaaag
atcacagtcaatggccagacggtgcggtacaagtgtaattgcggtggctcaaatgaaggactaacaactacagac
aaagtgattaataactgcaaggttgatcaatgtcatgccgcggtcaccaatcacaaaaattggcagtataactcc
cctctggtcccgcgtaatgctgaacttggggaccgaaaaggaaaaattcacatcccgtttccgctggcaaatgta
acatgcagggtgcctaaagcaaggaaccccaccgtgacgtacgggaaaaaccaagtcatcatgctactgtatcct
gaccacccaacactcctgtcctaccggaatatgggagaagaaccaaactatcaagaagagtgggtgatgcataag
aaggaagtcgtgctaaccgtgccgactgaagggctcgaggtcacgtggggcaacaacgagccgtataagtattgg
ccgcagttatctacaaacggtacagcccatggccacccgcatgagataattctgtattattatgagctgtacccc
actatgactgtagtagttgtgtcagtggccacgttcatactcctgtcgatggtgggtatggcagcggggatgtgc
atgtgtgcacgacgcagatgcatcacaccgtatgaactgacaccaggagctaccgtccctttcctgcttagccta
atatgctgcatcagaacagctaaagcggccacataccaagaggctgcgatatacctgtggaacgagcagcaacct
ttgttttggctacaagcccttattccgctggcagccctgattgttctatgcaactgtctgagactcttaccatgc
tgctgtaaaacgttggctttttttagccgtaatgagcgtcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca
gttaaggacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttgggggcgtcgccattattaaatatgcagccagcaagaaaggcaagtgtgcggtg
cattcgatgactaacgccgtcactattcgggaagctgagatagaagttgaagggaattctcagctgcaaatctct
ttctcgacggccttagccagcgccgaattccgcgtacaagtctgttctacacaagtacactgtgcagccgagtgc
cacccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcgggggggggg

Figure 29B continued ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 29C

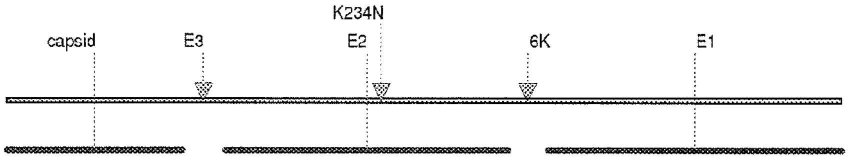

Translation of CMV/R-CHIKV C-E3-E2-6K-E1 (Strain OPY1) E2 K234N

1248 aa

MEFIPTQTFYNRRYQPRPWTPRPTIQVIRPRPRPQRQAGQLAQLISAVNKLTMRAVPQQKPRRNRKNKKQKQKQQ
APQNNTNQKKQPPKKKPAQKKKKPGRRERMCMKIENDCIFEVKHEGKVTGYACLVGDKVMKPAHVKGTIDNADLA
KLAFKRSSKYDLECAQIPVHMKSDASKFTHEKPEGYYNWHHGAVQYSGGRFTIPTGAGKPGDSGRPIFDNKGRVV
AIVLGGANEGARTALSVVTWNKDIVTKITPEGAEEWSLAIPVMCLLANTTFPCSQPPCTPCCYEKEPEETLRMLE
DNVMRPGYYQLLQASLTCSPHRQRRSTKDNFNVYKATRPYLAHCPDCGEGHSCHSPVALERIRNEATDGTLKIQV
SLQIGIKTDDSHDWTKLRYMDNHMPADAERAGLFVRTSAPCTITGTMGHFILARCPKGETLTVGFTDSRKISHSC
THPFHHDPPVIGREKFHSRPQHGKELPCSTYVQSTAATTEEIEVHMPPDTPDRTLMSQQSGNVKITVNGQTVRYK
CNCGGSNEGLTTTDKVINNCKVDQCHAAVTNHKNWQYNSPLVPRNAELGDRKGKIHIPFPLANVTCRVPKARNPT
VTYGKNQVIMLLYPDHPTLLSYRNMGEEPNYQEEWVMHKKEVVLTVPTEGLEVTWGNNEPYKYWPQLSTNGTAHG
HPHEIILYYYELYPTMTVVVVSVATFILLSMVGMAAGMCMCARRRCITPYELTPGATVPFLLSLICCIRTAKAAT
YQEAAIYLWNEQQPLFWLQALIPLAALIVLCNCLRLLPCCCKTLAFLAVMSVGAHTVSAYEHVTVIPNTVGVPYK
TLVNRPGYSPMVLEMELLSVTLEPTLSLDYITCEYKTVIPSPYVKCCGTAECKDKNLPDYSCKVFTGVYPFMWGG
AYCFCDAENTQLSEAHVEKSESCKTEFASAYRAHTASASAKLRVLYQGNNITVTAYANGDHAVTVKDAKFIVGPM
SSAWTPFDNKIVVYKGDVYNMDYPPFGAGRPGQFGDIQSRTPESKDVYANTQLVLQRPAVGTVHVPYSQAPSGFK
YWLKERGASLQHTAPFGCQIATNPVRAVNCAVGNMPISIDIPEAAFTRVVDAPSLTDMSCEVPACTHSSDFGGVA
IIKYAASKKGKCAVHSMTNAVTIREAEIEVEGNSQLQISFSTALASAEFRVQVCSTQVHCAAECHPPKDHIVNYP
ASHTTLGVQDISATAMSWVQKITGGVGLVVAVAALILIVVLCVSFSRH

Figure 30A

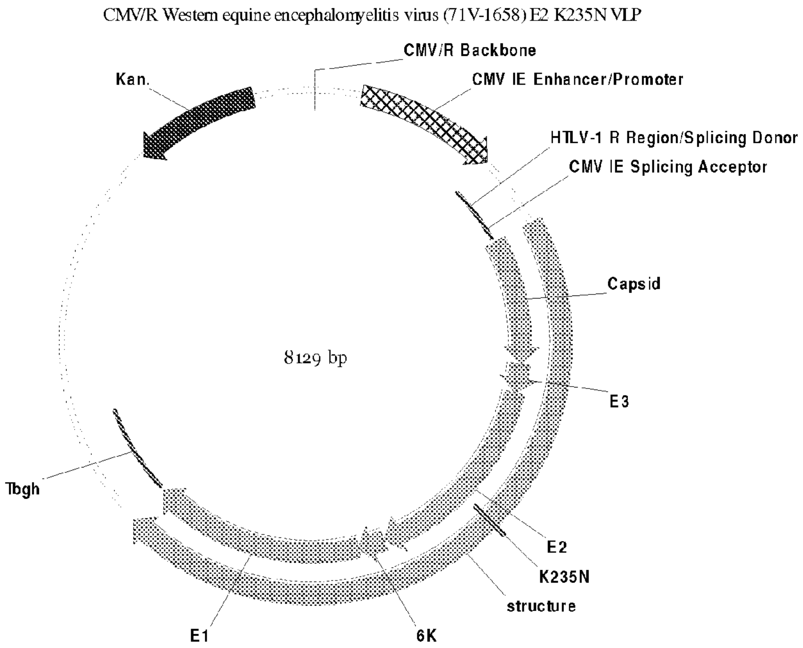

Figure 30B

Insert sequence atgtttccataccctcagctgaactttccaccagtttaccctacaaatccgatggcttaccgagatccaaaccct
cctaggcgccgctggaggccgtttcggcccccgctggctgctcaaatcgaagatcttaggaggtcgatagtcaac
ttgactttcaaacaacgatcacctaatccgccgccaggtccaccgccaaagaagaagaagagtgctcctaagcca
aaacctactcagcctaaaaagaagaagcagcaagccaagaggacgaaacgcaagcctaaaccagggaaacgacaa
cgtatgtgtatgaagttggagtcggacaagacatttccgatcatgctgaacggccaagtgaatggatatgcctgc
gttgtcggaggaaggctgatgaaaccactccacgttgaaggaaaaattgataatgagcaattagcggccgtgaaa
ttgaagaaggctagcatgtacgacttggagtacggcgacgttccccagaacatgaaatcagacacgctgcagtac
accagcgacaaaccaccgggcttctacaactggcaccacggcgcagtccagtatgagaatgggagatttaccgta
ccgagaggagtgggcgggaaaggcgacagcggaagaccgatcctggacaacagaggcagagttgtggctattgtt
ctaggaggtgcaaatgagggcacgcgtacggcgctttcagtggtcacttggaaccagaaaggggtgaccattagg
gataccccccgaaggttctgaaccgtggtcactagttacagcgctatgcgtgctttcgaatgtcacgttcccatgc
gacaaaccacccgtgtgctattcactgacgccagaacgaacactcgacgtgctcgaagagaacgtcgacaatcca
aattacgacacgctgctggagaacgtcttgaaatgtccatcacgccggcccaaacgaagcattaccgatgacttc
acactgaccagtccctacctggggttctgcccgtattgcagacactcaacgccgtgtttcagcccaataaaatt
gagaacgtgtgggacgaatctgatgatggatcgattagaatccaggtctcggcacaattcggctacaatcaggca
ggcactgcggatgtcaccaaattccgttacatgtctttcgaccacgaccatgacatcaaggaagacagtatggag
aaaatagctatcagcacatctggaccctgccgtcgtcttggccacaaagggtacttcctgttagctcaatgtcct
ccaggtgacagtgtaaccgtcagtatcacgagcggagcatctgagaattcatgcaccgtggagaaaaagatcagg
aggaagtttgtcggtagagaggagtacttgttcccacccgtccatggaaagctggtaaagtgccacgtttacgat
cacttgaaggagacgtctgccgggtacataaccatgcacaggccaggcccacacgcgtataagtcctatctggag
gaagcgtcaggcgaagtgtacattaaaccaccttctggcaagaacgtcacctacgaatgtaagtgtggcgactac
agcacaggtatcgtgagcacgcgaacgaagatgaacggctgcactaaagcaaaacagtgcattgcctacaagagc
gaccaaacgaattgggtcttcaactcgccggatcttattaggcacacagaccactcagtgcaaggtaaattgcac
attccattccgcttgacaccgacagtctgcccggttccgttagctcacacgcctacagtcacgaagtggttcaaa
ggcatcaccctccacctgactgcaatgcgaccaacattgctgacaacgagaaaattggggctgcgagcagacgca
acagcagaatggattacagggtctacatccaggaatttttctgtggggcgagaagggctggagtacgtatggggt
aaccatgaaccagtcagagtctgggcccaggagtcggcaccaggcgacccacatggatggccgcatgagatcatc

Figure 30B continued atccactattatcatcggcatccagtctacactgtcattgtgctgtgtggtgtcgctcttgctatcctggtaggc
actgcatcatcagcagcttgcatcgccaaagcaagaagagactgcctgacgccatacgcgcttgcaccgaacgca
acggtacccacagcattagcggttttgtgctgcattcggccaaccaacgctgaaacatttggagaaactttgaac
catctgtggtttaacaaccaaccgtttctctgggcacagttgtgcattcctctggcagcgcttgttattctgttc
cgctgcttttcatgctgcatgcctttttattggttgcaggcgtctgcctggggaaggtagacgccttcgaacat
gcgaccactgtgccaaatgttccggggatcccgtataaggcgttggtcgaacgcgcaggttacgcgccacttaac
ctggagatcacggtcgtctcatcggaattaacaccttcaactaacaaggagtacgtgacctgcaaattccacaca
gtcattccttcaccacaagttaaatgctgcgggtccctcgagtgcaaggcatcctcaaaggcggattacacatgc
cgcgtttttggcggtgtgtaccctttcatgtggggaggcgcacaatgcttctgtgacagtgagaacacacaactg
agtgaggcgtacgtcgagttcgctccagactgcactatagatcacgcagtcgcactaaaagttcacacagctgct
ctgaaagtcggcctgcgtatagtatacggcaacaccaccgcgcacctggatacgtttgtcaatggcgtcacgcca
ggttcctcacgggacctgaaggtcatagcagggccgatatcagccgctttttcaccctttgaccataaggtcgtc
atcagaaaggggcttgtttacaactacgacttccctgagtatggagctatgaaaccaggagcgttcggcgatatt
caagcatcctcgcttgatgctacagacatagtagcccgcactgacatacggctgctgaagccttctgtcaagaac
atccacgtcccctacacccaagcagtatcagggtatgaaatgtggaagaacaactcaggacgacccctgcaagaa
acagcaccatttggatgtaaaattgaagtggagcctctgcgagcgtctaactgtgcttacgggcacatccctatc
tcgattgacatccctgatgcagcttttgtgagatcatcagaatcaccaacaattttagaagttagctgcacagta
gcagactgcatttattctgcagactttggtggttctctaacattacagtacaaagctgacagggagggacattgt
ccagttcactcccactccacgacagctgttttgaaggaagcgaccacacatgtgactgccgtaggcagcataaca
ctacattttagcacatcgagcccacaagcaaattttatagtttcgctatgcggcaagaagtccacctgcaatgct
gaatgtaaaccaccggccgaccacataattggagaaccacataaagtcgaccaagaattccaggcggcagtttcc
aaaacatcttggaactggctgcttgcactgtttggggggagcatcatccctcattgttgtaggacttatagtgttg
gtctgcagctctatgcttataaacacacgtagatga Vector sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttccataccctcagctgaactttccaccagtttaccctacaaat
ccgatggcttaccgagatccaaaccctcctaggcgccgctggaggccgtttcggcccccgctggctgctcaaatc
gaagatcttaggaggtcgatagtcaacttgactttcaaacaacgatcacctaatccgccgccaggtccaccgcca
aagaagaagaagagtgctcctaagccaaaacctactcagcctaaaaagaagaagcagcaagccaagaggacgaaa
cgcaagcctaaaccagggaaacgacaacgtatgtgtatgaagttggagtcggacaagacatttccgatcatgctg
aacggccaagtgaatggatatgcctgcgttgtcggaggaaggctgatgaaaccactccacgttgaaggaaaatt
gataatgagcaattagcggccgtgaaattgaagaaggctagcatgtacgacttggagtacggcgacgttccccag
aacatgaaatcagacacgctgcagtacaccagcgacaaaccaccgggcttctacaactggcaccacggcgcagtc
cagtatgagaatgggagatttaccgtaccgagaggagtgggcgggaaaggcgacagcggaagaccgatcctggac
aacagaggcagagttgtggctattgttctaggaggtgcaaatgagggcacgcgtacggcgctttcagtggtcact
tggaaccagaaagggggtgaccattagggatacccccgaaggttctgaaccgtggtcactagttacagcgctatgc
gtgctttcgaatgtcacgttcccatgcgacaaaccacccgtgtgctattcactgacgccagaacgaacactcgac
gtgctcgaagagaacgtcgacaatccaaattacgacacgctgctggagaacgtcttgaaatgtccatcacgccgg
cccaaacgaagcattaccgatgacttcacactgaccagtccctacctggggttctgcccgtattgcagacactca
acgccgtgtttcagcccaataaaaattgagaacgtgtgggacgaatctgatgatggatcgattagaatccaggtc
tcggcacaattcggctacaatcaggcaggcactgcggatgtcaccaaattccgttacatgtctttcgaccacgac

Figure 30B continued catgacatcaaggaagacagtatggagaaaatagctatcagcacatctggaccctgccgtcgtcttggccacaaa
gggtacttcctgttagctcaatgtcctccaggtgacagtgtaaccgtcagtatcacgagcggagcatctgagaat
tcatgcaccgtggagaaaaagatcaggaggaagtttgtcggtagagaggagtacttgttcccacccgtccatgga
aagctggtaaagtgccacgtttacgatcacttgaaggagacgtctgccgggtacataaccatgcacaggccaggc
ccacacgcgtataagtcctatctggaggaagcgtcaggcgaagtgtacattaaaccaccttctggcaagaacgtc
acctacgaatgtaagtgtggcgactacagcacaggtatcgtgagcacgcgaacgaagatgaacggctgcactaaa
gcaaaacagtgcattgcctacaagagcgaccaaacgaattgggtcttcaactcgccggatcttattaggcacaca
gaccactcagtgcaaggtaaattgcacattccattccgcttgacaccgacagtctgcccggttccgttagctcac
acgcctacagtcacgaagtggttcaaaggcatcaccctccacctgactgcaatgcgaccaacattgctgacaacg
agaaaattggggctgcgagcagacgcaacagcagaatggattacagggtctacatccaggaattttctgtgggg
cgagaagggctggagtacgtatggggtaaccatgaaccagtcagagtctgggcccaggagtcggcaccaggcgac
ccacatggatggccgcatgagatcatcatccactattatcatcggcatccagtctacactgtcattgtgctgtgt
ggtgtcgctcttgctatcctggtaggcactgcatcatcagcagcttgcatcgccaaagcaagaagagactgcctg
acgccatacgcgcttgcaccgaacgcaacggtacccacagcattagcggttttgtgctgcattcggccaaccaac
gctgaaacatttggagaaactttgaaccatctgtggtttaacaaccaaccgtttctctgggcacagttgtgcatt
cctctggcagcgcttgttattctgttccgctgcttttcatgctgcatgcctttttttattggttgcaggcgtctgc
ctggggaaggtagacgccttcgaacatgcgaccactgtgccaaatgttccggggatcccgtataaggcgttggtc
gaacgcgcaggttacgcgccacttaacctggagatcacggtcgtctcatcggaattaacaccttcaactaacaag
gagtacgtgacctgcaaattccacacagtcattccttcaccacaagttaaatgctgcgggtccctcgagtgcaag
gcatcctcaaaggcggattacacatgccgcgttttggcggtgtgtaccctttcatgtggggaggcgcacaatgc
ttctgtgacagtgagaacacacaactgagtgaggcgtacgtcgagttcgctccagactgcactatagatcacgca
gtcgcactaaaagttcacacagctgctctgaaagtcggcctgcgtatagtatacggcaacaccaccgcgcacctg
gatacgtttgtcaatggcgtcacgccaggttcctcacgggacctgaaggtcatagcagggccgatatcagccgct
ttttcaccctttgaccataaggtcgtcatcagaaaggggcttgtttacaactacgacttccctgagtatggagct
atgaaaccaggagcgttcggcgatattcaagcatcctcgcttgatgctacagacatagtagcccgcactgacata
cggctgctgaagccttctgtcaagaacatccacgtcccctacacccaagcagtatcagggtatgaaatgtggaag
aacaactcaggacgacccctgcaagaaacagcaccatttggatgtaaaattgaagtggagcctctgcgagcgtct
aactgtgcttacgggcacatccctatctcgattgacatccctgatgcagcttttgtgagatcatcagaatcacca
acaattttagaagttagctgcacagtagcagactgcatttattctgcagactttggtggttctctaacattacag
tacaaagctgacaggagggacattgtccagttcactcccactccacgacagctgtttgaaggaagcgaccaca
catgtgactgccgtaggcagcataacactacattttagcacatcgagcccacaagcaattttatagtttcgcta
tgcggcaagaagtccacctgcaatgctgaatgtaaaccaccggccgaccacataattggagaaccacataaagtc
gaccaagaattccaggcggcagtttccaaaacatcttggaactggctgcttgcactgtttggggagcatcatcc
ctcattgttgtaggacttatagtgttggtctgcagctctatgcttataaacacacgtagatgatctagaccaggc
cctggatccagatctgctgtgccttctagttgccagccatctgttgtttgcccctcccccgtgccttccttgacc
ctggaaggtgccactcccactgtcctttcctaataaaatgaggaaattgcatcgcattgtctgagtaggtgtcat
tctattctggggggtggggtggggcaggacagcaagggggaggattgggaagacaatagcaggcatgctggggat
gcggtgggctctatgggtacccaggtgctgaagaattgacccggttcctcctgggccagaaagaagcaggcacat
ccccttctctgtgacacaccctgtccacgcccctggttcttagttccagccccactcataggacactcatagctc
aggagggctccgccttcaatcccacccgctaaagtacttggagcggtctctccctccctcatcagcccaccaaac
caaacctagcctccaagagtgggaagaaattaaagcaagataggctattaagtgcagagggagagaaaatgcctc
caacatgtgaggaagtaatgagagaaatcatagaattttaaggccatgatttaaggccatcatggccttaatctt
ccgcttcctcgctcactgactcgctgcgctcggtcgttcggctgcggcgagcggtatcagctcactcaaaggcgg
taatacggttatccacagaatcaggggataacgcaggaaagaacatgtgagcaaaaggccagcaaaaggccagga
accgtaaaaaggccgcgttgctggcgtttttccataggctccgcccccctgacgagcatcacaaaaatcgacgct
caagtcagaggtggcgaaacccgacaggactataaagataccaggcgtttccccctggaagctccctcgtgcgct
ctcctgttccgaccctgccgcttaccggatacctgtccgcctttctcccttcgggaagcgtggcgctttctcata
gctcacgctgtaggtatctcagttcggtgtaggtcgttcgctccaagctgggctgtgtgcacgaaccccccgttc
agcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggccta
actacggctacactagaagaacagtatttggtatctgcgctctgctgaagccagttaccttcggaaaaagagttg
gtagctcttgatccggcaaacaaaccaccgctggtagcggtggtttttttgtttgcaagcagcagattacgcgca
gaaaaaaaggatctcaagaagatcctttgatcttttctacggggtctgacgctcagtggaacgaaaactcacgtt
aagggattttggtcatgagattatcaaaaaggatcttcacctagatccttttaaattaaaaatgaagttttaaat
caatctaaagtatatatgagtaaacttggtctgacagttaccaatgcttaatcagtgaggcacctatctcagcga
tctgtctatttcgttcatccatagttgcctgactcggggggggggggcgctgaggtctgcctcgtgaagaaggtg
ttgctgactcataccaggcctgaatcgccccatcatccagccagaaagtgagggagccacggttgatgagagctt
tgttgtaggtggaccagttggtgattttgaacttttgctttgccacggaacggtctgcgttgtcgggaagatgcg
tgatctgatccttcaactcagcaaaagttcgatttattcaacaaagccgccgtcccgtcaagtcagcgtaatgct
ctgccagtgttacaaccaattaaccaattctgattagaaaactcatcgagcatcaaatgaaactgcaatttatt
catatcaggattatcaataccatatttttgaaaaagccgtttctgtaatgaaggagaaaactcaccgaggcagtt

Figure 30B continued ccataggatggcaagatcctggtatcggtctgcgattccgactcgtccaacatcaatacaacctattaatttccc
ctcgtcaaaaataaggttatcaagtgagaaatcaccatgagtgacgactgaatccggtgagaatggcaaaagctt
atgcatttctttccagacttgttcaacaggccagccattacgctcgtcatcaaaatcactcgcatcaaccaaacc
gttattcattcgtgattgcgcctgagcgagacgaaatacgcgatcgctgttaaaaggacaattacaaacaggaat
cgaatgcaaccggcgcaggaacactgccagcgcatcaacaatattttcacctgaatcaggatattcttctaatac
ctggaatgctgttttcccggggatcgcagtggtgagtaaccatgcatcatcaggagtacggataaaatgcttgat
ggtcggaagaggcataaattccgtcagccagtttagtctgaccatctcatctgtaacatcattggcaacgctacc
tttgccatgtttcagaaacaactctggcgcatcgggcttcccatacaatcgatagattgtcgcacctgattgccc
gacattatcgcgagcccatttatacccatataaatcagcatccatgttggaatttaatcgcggcctcgagcaaga
cgtttcccgttgaatatggctcataacaccccttgtattactgtttatgtaagcagacagttttattgttcatga
tgatatatttttatcttgtgcaatgtaacatcagagattttgagacacaacgtggctttccccccccccccatta
ttgaagcatttatcagggttattgtctcatgagcggatacatatttgaatgtatttagaaaaataaacaaatagg
ggttccgcgcacatttccccgaaaagtgccacctgacgtctaagaaaccattattatcatgacattaacctataa
aaataggcgtatcacgaggccctttcgtc

Figure 30C

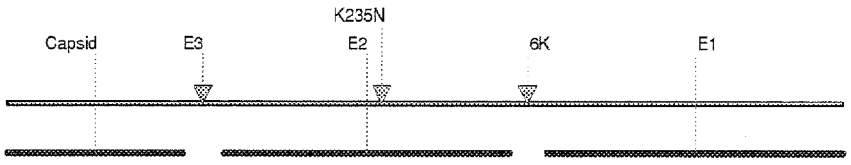

Translation of CMV/R Western equine encephalomyelitis virus (71V-1658) E2 K235N VLP

1236 aa

MFPYPQLNFPPVYPTNPMAYRDPNPPRRRWRPFRPPLAAQIEDLRRSIVNLTFKQRSPNPPPGPPPKKKKSAPKP
KPTQPKKKKQQAKRTKRKPKPGKRQRMCMKLESDKTFPIMLNGQVNGYACVVGGRLMKPLHVEGKIDNEQLAAVK
LKKASMYDLEYGDVPQNMKSDTLQYTSDKPPGFYNWHHGAVQYENGRFTVPRGVGGKGDSGRPILDNRGRVVAIV
LGGANEGTRTALSVVTWNQKGVTIRDTPEGSEPWSLVTALCVLSNVTFPCDKPPVCYSLTPERTLDVLEENVDNP
NYDTLLENVLKCPSRRPKRSITDDFTLTSPYLGFCPYCRHSTPCFSPIKIENVWDESDDGSIRIQVSAQFGYNQA
GTADVTKFRYMSFDHDHDIKEDSMEKIAISTSGPCRRLGHKGYFLLAQCPPGDSVTVSITSGASENSCTVEKKIR
RKFVGREEYLFPPVHGKLVKCHVYDHLKETSAGYITMHRPGPHAYKSYLEEASGEVYIKPPSGKNVTYECKCGDY
STGIVSTRTKMNGCTKAKQCIAYKSDQTNWVFNSPDLIRHTDHSVQGKLHIPFRLTPTVCPVPLAHTPTVTKWFK
GITLHLTAMRPTLLTTRKLGLRADATAEWITGSTSRNFSVGREGLEYVWGNHEPVRVWAQESAPGDPHGWPHEII
IHYYHRHPVYTVIVLCGVALAILVGTASSAACIAKARRDCLTPYALAPNATVPTALAVLCCIRPTNAETFGETLN
HLWFNNQPFLWAQLCIPLAALVILFRCFSCCMPFLLVAGVCLGKVDAFEHATTVPNVPGIPYKALVERAGYAPLN
LEITVVSSELTPSTNKEYVTCKFHTVIPSPQVKCCGSLECKASSKADYTCRVFGGVYPFMWGGAQCFCDSENTQL
SEAYVEFAPDCTIDHAVALKVHTAALKVGLRIVYGNTTAHLDTFVNGVTPGSSRDLKVIAGPISAAFSPFDHKVV
IRKGLVYNYDFPEYGAMKPGAFGDIQASSLDATDIVARTDIRLLKPSVKNIHVPYTQAVSGYEMWKNNSGRPLQE
TAPFGCKIEVEPLRASNCAYGHIPISIDIPDAAFVRSSESPTILEVSCTVADCIYSADFGGSLTLQYKADREGHC
PVHSHSTTAVLKEATTHVTAVGSITLHFSTSSPQANFIVSLCGKKSTCNAECKPPADHIIGEPHKVDQEFQAAVS
KTSWNWLLALFGGASSLIVVGLIVLVCSSMLINTRR

Figure 31A

CMV/R-CHIKV C-E3-E2(37997)-6K-E1 (Strain OPY1)

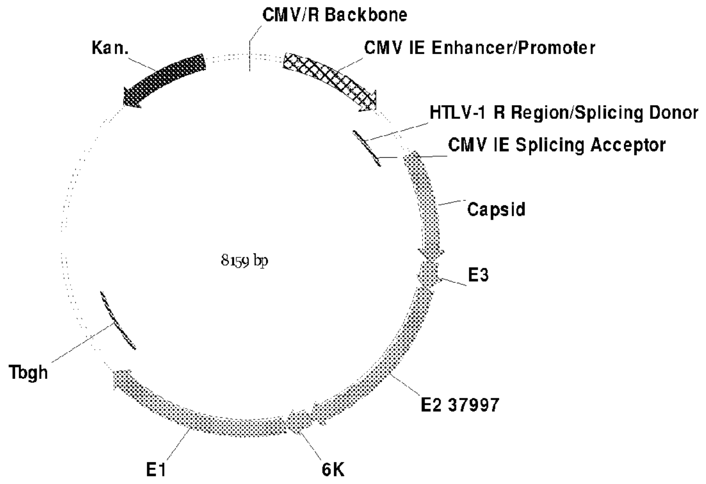

Figure 31B

Insert sequence atggagttcatcccaacccaaacttttacaataggaggtaccagcctcgaccctggactccgcgccctactatc
caagtcatcaggcccagaccgcgccctcagaggcaagctgggcaacttgcccagctgatctcagcagttaataaa
ctgacaatgcgcgcggtaccacaacagaagccacgcaggaatcggaagaataagaagcaaaagcaaaaacaacag
gcgccacaaaacaacacaaatcaaaagaagcagccacctaaaaagaaaccggctcaaaagaaaaagaagccgggc
cgcagagagaggatgtgcatgaaaatcgaaaatgattgtattttcgaagtcaagcacgaaggtaaggtaacaggt
tacgcgtgcctggtggggacaaagtaatgaaaccagcacacgtaaaggggaccatcgataacgcggacctggcc
aaactggcctttaagcggtcatctaagtatgaccttgaatgcgcgcagatacccgtgcacatgaagtccgacgct
tcgaagttcacccatgagaaaccggaggggtactacaactggcaccacggagcagtacagtactcaggaggccgg
ttcaccatccctacaggtgctggcaaaccaggggacagcggcagaccgatcttcgacaacaagggacgcgtggtg
gccatagtcttaggaggagctaatgaaggagcccgtacagccctctcggtggtgacctggaataaagacattgtc
actaaaatcacccccgaggggccgaagagtggagtcttgccatcccagttatgtgcctgttggcaaacaccacg
ttcccctgctcccagccccccttgcacgccctgctgctacgaaaaggaaccggaggaaaccctacgcatgcttgag
gacaacgtcatgagacctgggtactatcagctgctacaagcatccttaacatgttctccccaccgccagcgacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
taccaagaggctgcgatatacctgtggaacgagcagcaacctttgttttggctacaagcccttattccgctggca

Figure 31B continued gccctgattgttctatgcaactgtctgagactcttaccatgctgctgtaaaacgttggctttttagccgtaatg
agcgtcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgcgagtacaaaaccgtcatcccgtctccgtacgtgaagtgctgcggtacagca
gagtgcaaggacaaaaacctacctgactacagctgtaaggtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaaataac
atcactgtaactgcctatgcaaacggcgaccatgccgtcacagttaaggacgccaaattcattgtggggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactaggtcgtc
gacgcgccctctttaacggacatgtcgtgcgaggtaccagcctgcacccattcctcagactttgggggcgtcgcc
attattaaatatgcagccagcaagaaaggcaagtgtgcggtgcattcgatgactaacgccgtcactattcggaa
gctgagatagaagttgaagggaattctcagctgcaaatctctttctcgacggccttagccagcgccgaattccgc
gtacaagtctgttctacacaagtacactgtgcagccgagtgccacccccgaaggaccacatagtcaactacccg
gcgtcacataccaccctcggggtccaggacatctccgctacggcgatgtcatgggtgcagaagatcacgggaggt
gtgggactggttgttgctgttgccgcactgattctaatcgtggtgctatgcgtgtcgttcagcaggcac Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccaacccaaactttttacaataggaggtac
cagcctcgaccctggactccgcgccctactatccaagtcatcaggcccagaccgcgccctcagaggcaagctggg
caacttgcccagctgatctcagcagttaataaactgacaatgcgcgcggtaccacaacagaagccacgcaggaat
cggaagaataagaagcaaaagcaaaaacaacaggcgccacaaaacaacacaaatcaaaagaagcagccacctaaa
aagaaaccggctcaaaagaaaaagaagccgggccgcagagagaggatgtgcatgaaaatcgaaaatgattgtatt
ttcgaagtcaagcacgaaggtaaggtaacaggttacgcgtgcctggtgggggacaaagtaatgaaaccagcacac
gtaaaggggaccatcgataacgcggacctggccaaactggcctttaagcggtcatctaagtatgaccttgaatgc
gcgcagatacccgtgcacatgaagtccgacgcttcgaagttcacccatgagaaaccggagggtactacaactgg
caccacggagcagtacagtactcaggaggccggttcaccatccctacaggtgctggcaaaccaggggacagcggc
agaccgatcttcgacaacaagggacgcgtggtggccatagtcttaggaggagctaatgaaggagcccgtacagcc
ctctcggtggtgacctggaataaagacattgtcactaaaatcacccccgaggggggccgaagagtggagtcttgcc
atcccagttatgtgcctgttggcaaacaccacgttcccctgctcccagccccttgcacgccctgctgctacgaa
aaggaaccggaggaaaccctacgcatgcttgaggacaacgtcatgagacctgggtactatcagctgctacaagca
tccttaacatgttctccccaccgccagcgacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct

Figure 31B continued gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
ccttttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttgcggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacataccaagaggctgcgatatacctctggaacgagcagcaacct
ttgttttggctacaagcccttattccgctggcagccctgattgttctatgcaactgtctgagactcttaccatgc
tgctgtaaaacgttggctttttagccgtaatgagcgtcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca
gttaaggacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttgggggcgtcgccattattaaatatgcagccagcaagaaaggcaagtgtgcggtg
cattcgatgactaacgccgtcactattcgggaagctgagatagaagttgaagggaattctcagctgcaaatctct
ttctcgacggccttagccagcgccgaattccgcgtacaagtctgttctacacaagtacactgtgcagccgagtgc
cacccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcgggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc

Figure 31B continued gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 31C

Translation of CMV/R-CHIKV C E3 E2(37997)-6K-E1 (OPY1)

1248 aa

MEFIPTQTFYNRRYQPRPWAPRPTIQVIRPRPRPQRQAGQLAQLISAVNKLTMRAVPQQKPRRNRKNKKQRQKKQ
APQNDPKQKKQPPQKKPAQKKKKPGRRERMCMKIENDCIFEVKHEGKVMGYACLVGDKVMKPAHVKGTIDNADLA
KLAFKRSSKYDLECAQIPVHMKSDASKFTHEKPEGYYNWHHGAVQYSGGRFTIPTGAGKPGDSGRPIFDNKGRVV
AIVLGGANEGARTALSVVTWNKDIVTKITPEGAEEWSLALPVLCLLANTTFPCSQPPCTPCCYEKEPESTLRMLE
DNVMRPGYYQLLKASLTCSPHRQRRSTKDNFNVYKATRPYLAHCPDCGEGHSCHSPIALERIRNEATDGTLKIQV
SLQIGIKTDDSHDWTKLRYMDSHTPADAERAGLLVRTSAPCTITGTMGHFILARCPKGETLTVGFTDSRKISHTC
THPFHHEPPVIGRERFHSRPQHGKELPCSTYVQSTAATAEEIEVHMPPDTPDRTLMTQQSGNVKITVNGQTVRYK
CNCGGSNEGLTTTDKVINNCKIDQCHAAVTNHKNWQYNSPLVPRNAELGDRKGKIHIPFPLANVICRVPKARNPT
VTYGKNQVTMLLYPDHPTLLSYRNMGQEPNYHEEWVTHKKEVTLTVPTEGLEVTWGNNEPYKYWPQMSTNGTAHG
HPHEIILYYYELYPTMTVVIVSVASFVLLSMVGTAVGMCVCARRRCITPYELTPGATVPFLLSLLCCVRTTKAAT
YQEAAIYLWNEQQPLFWLQALIPLAALIVLCNCLRLLPCCCKTLAFLAVMSVGAHTVSAYEHVTVIPNTVGVPYK
TLVNRPGYSPMVLEMELLSVTLEPTLSLDYITCEYKTVIPSPYVKCCGTAECKDKNLPDYSCKVFTGVYPFMWGG
AYCFCDAENTQLSEAHVEKSESCKTEFASAYRAHTASASAKLRVLYQGNNITVTAYANGDHAVTVKDAKFIVGPM
SSAWTPFDNKIVVYKGDVYNMDYPPFGAGRPGQFGDIQSRTPESKDVYANTQLVLQRPAVGTVHVPYSQAPSGFK
YWLKERGASLQHTAPFGCQIATNPVRAVNCAVGNMPISIDIPEAAFTRVVDAPSLTDMSCEVPACTHSSDFGGVA
IIKYAASKKGKCAVHSMTNAVTIREAEIEVEGNSQLQISFSTALASAEFRVQVCSTQVHCAAECHPPKDHIVNYP
ASHTTLGVQDISATAMSWVQKITGGVGLVVAVAALILIVVLCVSFSRH

Figure 32A

CMV/R-CHIKV C E3 E2 6K(37997)-E1 (OPY1)

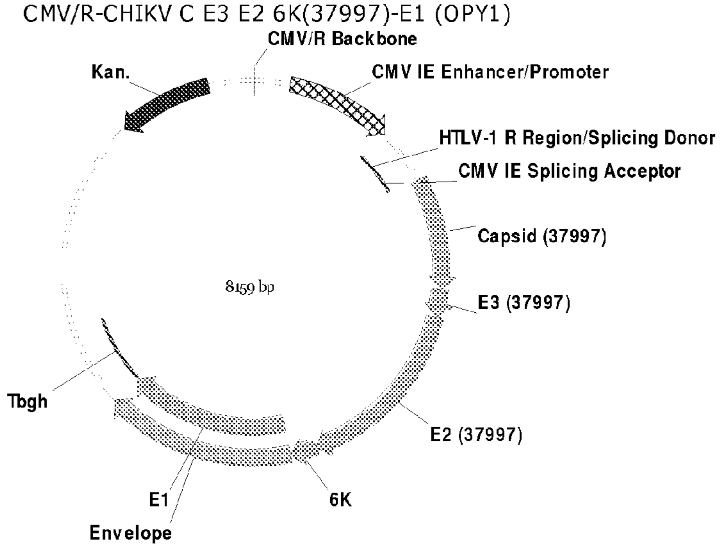

Figure 32B

Insert sequence atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctcgcagaaatcggaaaaacaagaagcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggaggggccaacgaaggtgcccgcacggccctctccgtggtgacgtggaacaaagacatcgtc
acaaaaattacccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca

Figure 32B continued tattacgaggctgcggcatatctatggaacgaacagcagcccctgttctggttgcaggctcttatcccgctggcc
gccttgatcgtcctgtgcaactgtctgaaactcttgccatgctgctgtaagaccctggctttttagccgtaatg
agcatcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgcgagtacaaaaccgtcatcccgtctccgtacgtgaagtgctgcggtacagca
gagtgcaaggacaaaaacctacctgactacagctgtaagcgtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaaataac
atcactgtaactgcctatgcaaacggcgaccatgccgtcacagttaaggacgccaaattcattgtggggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactagggtcgtc
gacgcgccctctttaacggacatgtcgtgcgaggtaccagcctgcacccattcctcagactttgggggcgtcgcc
attattaaatatgcagccagcaagaaaggcaagtgtgcggtgcattcgatgactaacgccgtcactattcgggaa
gctgagatagaagttgaagggaattctcagctgcaaatctctttctcgacggccttagccagcgccgaattccgc
gtacaagtctgttctacacaagtacactgtgcagccgagtgccaccccccgaaggaccacatagtcaactacccg
gcgtcacataccaccctcggggtccaggacatctccgctacggcgatgtcatgggtgcagaagatcacgggaggt
gtgggactggttgttgctgttgccgcactgattctaatcgtggtgctatgcgtgtcgttcagcaggcac Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctggccccacgccctacaattcaagtaattagacctagaccacgtccacagaggcaggctggg
caactcgcccagctgatctccgcagtcaacaaattgaccatgcgcgcggtacctcaacagaagcctcgcagaaat
cggaaaaacaagaagcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgagggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca

Figure 32B continued ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgaggctctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca
gttaagcacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttgggggcgtcgccattattaaatatgcagccagcaagaaaggcaagtgtgcggtg
cattcgatgactaacgccgtcactattcgggaagctgagatagaagttgaagggaattctcagctgcaaatctct
ttctcgacggccttagccagcgccgaattccgcgtacaagtctgttctacacaagtacactgtgcagccgagtgc
cacccccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaatttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg

Figure 32B continued tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 32C

Translation of CMV/R-CHIKV C E3 E2 6K(37997)-E1 (OPY1)

1248 aa

MEFIPTQTFYNRRYQPRPWAPRPTIQVIRPRPRPQRQAGQLAQLISAVNKLTMRAVPQQKPRRNRKNKKQRQKKQ
APQNDPKQKKQPPQKKPAQKKKKPGRRERMCMKIENDCIFEVKHEGKVMGYACLVGDKVMKPAHVKGTIDNADLA
KLAFKRSSKYDLECAQIPVHMKSDASKFTHEKPEGYYNWHHGAVQYSGGRFTIPTGAGKPGDSGRPIFDNKGRVV
AIVLGGANEGARTALSVVTWNKDIVTKITPEGAEEWSLALPVLCLLANTTFPCSQPPCTPCCYEKEPESTLRMLE
DNVMRPGYYQLLKASLTCSPHRQRRSTKDNFNVYKATRPYLAHCPDCGEGHSCHSPIALERIRNEATDGTLKIQV
SLQIGIKTDDSHDWTKLRYMDSHTPADAERAGLLVRTSAPCTITGTMGHFILARCPKGETLTVGFTDSRKISHTC
THPFHHEPPVIGRERFHSRPQHGKELPCSTYVQSTAATAEEIEVHMPPDTPDRTLMTQQSGNVKITVNGQTVRYK
CNCGGSNEGLTTTDKVINNCKIDQCHAAVTNHKNWQYNSPLVPRNAELGDRKGKIHIPFPLANVTCRVPKARNPT
VTYGKNQVTMLLYPDHPTLLSYRNMGQEPNYHEEWVTHKKEVTLTVPTEGLEVTWGNNEPYKYWPQMSTNGTAHG
HPHEIILYYYELYPTMTVVIVSVASFVLLSMVGTAVGMCVCARRRCITPYELTPGATVPFLLSLLCCVRTTKAAT
YYEAAAYLWNEQQPLFWLQALIPLAALIVLCNCLKLLPCCCKTLAFLAVMSIGAHTVSAYEHVTVIPNTVGVPYK
TLVNRPGYSPMVLEMELLSVTLEPTLSLDYITCEYKTVIPSPYVKCCGTAECKDKNLPDYSCKVFTGVYPFMWGG
AYCFCDAENTQLSEAHVEKSESCKTEFASAYRAHTASASAKLRVLYQGNNITVTAYANGDHAVTVKDAKFIVGPM
SSAWTPFDNKIVVYKGDVYNMDYPPFGAGRPGQFGDIQSRTPESKDVYANTQLVLQRPAVGTVHVPYSQAPSGFK
YWLKERGASLQHTAPFGCQIATNPVRAVNCAVGNMPISIDIPEAAFTRVVDAPSLTDMSCEVPACTHSSDFGGVA
IIKYAASKKGKCAVHSMTNAVTIREAEIEVEGNSQLQISFSTALASAEFRVQVCSTQVHCAAECHPPKDHIVNYP
ASHTTLGVQDISATAMSWVQKITGGVGLVVAVAALILIVVLCVSFSRH

Figure 33A

CMV/R-CHIKV C-E3-6K-E1 (Strain OPY1)-E2(strain 37997)

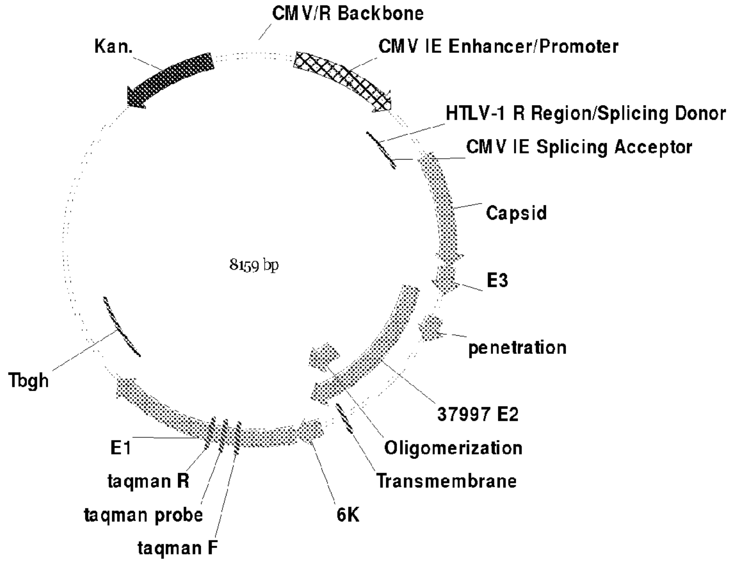

Figure 33B

Insert sequence atggagttcatcccaacccaaactttttacaataggaggtaccagcctcgaccctggactccgcgccctactatc
caagtcatcaggcccagaccgcgccctcagaggcaagctgggcaacttgcccagctgatctcagcagttaataaa
ctgacaatgcgcgcggtaccacaacagaagccacgcaggaatcggaagaataagaagcaaaagcaaaaacaacag
gcgccacaaaacaacacaaatcaaaagaagcagccacctaaaaagaaaccggctcaaaagaaaaagaagccgggc
cgcagagagaggatgtgcatgaaaatcgaaaatgattgtattttcgaagtcaagcacgaaggtaaggtaacaggt
tacgcgtgcctggtgggggacaaagtaatgaaaccagcacacgtaaaggggaccatcgataacgcggacctggcc
aaactggcctttaagcggtcatctaagtatgaccttgaatgcgcgcagatacccgtgcacatgaagtccgacgct
tcgaagttcacccatgagaaaccggaggggtactacaactggcaccacggagcagtacagtactcaggaggccgg
ttcaccatccctacaggtgctggcaaaccaggggacagcggcagaccgatcttcgacaacaagggacgcgtggtg
gccatagtcttaggaggagctaatgaaggagcccgtacagccctctcggtggtgacctggaataaagacattgtc
actaaaatcacccccgaggggggccgaagagtggagtcttgccatcccagttatgtgcctgttggcaaacaccacg
ttcccctgctcccagccccttgcacgccctgctgctacgaaaaggaaccggaggaaaccctacgcatgcttgag
gacaacgtcatgagacctgggtactatcagctgctacaagcatccttaacatgttctccccaccgccagcgacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat

Figure 33B continued gaattaacaccaggagccactgttcccttcctgctcagcctgctatgctgcgtcagaacgaccaaggcggccaca
taccaagaggctgcgatatacctgtggaacgagcagcaacctttgttttggctacaagcccttattccgctggca
gccctgattgttctatgcaactgtctgagactcttaccatgctgctgtaaaacgttggctttttagccgtaatg
agcgtcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgcgagtacaaaaccgtcatcccgtctccgtacgtgaagtgctgcggtacagca
gagtgcaaggacaaaaacctacctgactacagctgtaaggtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaaataac
atcactgtaactgcctatgcaaacggcgaccatgccgtcacagttaaggacgccaaattcattgtcgggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactagggtcgtc
gacgcgccctctttaacggacatgtcgtgcgaggtaccagcctgcacccattcctcagactttggggggcgtcgcc
attattaaatatgcagccagcaagaaaggcaagtgtgcggtgcattcgatgactaacgccgtcactattcgggaa
gctgagatagaagttgaagggaattctcagctgcaaatctctttctcgacggccttagccagcgccgaattccgc
gtacaagtctgttctacacaagtacactgtgcagccgagtgccacccccgaaggaccacatagtcaactacccg
gcgtcacataccaccctcggggtccagcacatctccgctacggcgatgtcatgggtgcagaagatcacgggaggt
gtgggactggttgttgctgttgccgcactgattctaatcgtggtgctatgcgtgtcgttcagcaggcac Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccaacccaaactttttacaataggaggtac
cagcctcgaccctggactccgcgccctactatccaagtcatcaggcccagaccgcgccctcagaggcaagctggg
caacttgcccagctgatctcagcagttaataaactgacaatgcgcgcggtaccacaacagaagccacgcaggaat
cggaagaataagaagcaaaagcaaaaacaacaggcgccacaaaacaacacaaatcaaaagaagcagccacctaaa
aagaaaccggctcaaaagaaaaagaagccgggccgcagagagaggatgtgcatgaaaatcgaaaatgattgtatt
ttcgaagtcaagcacgaaggtaaggtaacaggttacgcgtgcctggtgggggacaaagtaatgaaaccagcacac
gtaaaggggaccatcgataacgcggacctggccaaactggcctttaagcggtcatctaagtatgaccttgaatgc
gcgcagatacccgtgcacatgaagtccgacgcttcgaagttcacccatgagaaaccggaggggtactacaactgg
caccacggagcagtacagtactcaggaggccggttcaccatccctacaggtgctggcaaaccaggggacagcggc
agaccgatcttcgacaacaagggacgcgtggtggccatagtcttaggaggagctaatgaaggagcccgtacagcc
ctctcggtggtgacctggaataaagacattgtcactaaaatcacccccgagggggccgaagagtggagtcttgcc
atcccagttatgtgcctgttggcaaacaccacgttcccctgctcccagcccccttgcacgccctgctgctacgaa
aaggaaccggaggaaaccctacgcatgcttgaggacaacgtcatgagacctgggtactatcagctgctacaagca
tccttaacatgttctccccaccgccagcgacgcagtactaaggacaatttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg

Figure 33B continued accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacataccaagaggctgcgatatacctgtggaacgagcagcaacct
ttgttttggctacaagcccttattccgctggcagccctgattgttctatgcaactgtctgagactcttaccatgc
tgctgtaaaacgttggctttttagccgtaatgagcgtcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca
gttaaggacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttgggggcgtcgccattattaaatatgcagccagcaagaaaggcaagtgtgcggtg
cattcgatgactaacgccgtcactattcggaagctgagatagaagttgaagggaattctcagctgcaaatctct
ttctcgacggccttagccagcgccgaattccgcgtacaagtctgttctacacaagtacactgtgcagccgagtgc
cacccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcgggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaactc
atcgagcatcaaatgaaactgcaatttattcatatcaggattatcaataccatattttgaaaaagccgtttctg

Figure 33B continued taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 33C

Translation of CMV/R-CHIKV C-E3-6K-E1 (Strain OPY1)-E2(strain 37997)

1248 aa

MEFIPTQTFYNRRYQPRPWTPRPTIQVIRPRPRPQRQAGQLAQLISAVNKLTMRAVPQQKPRRNRKNKKQKQKQQ
APQNNTNQKKQPPKKKPAQKKKKPGRRERMCMKIENDCIFEVKHEGKVTGYACLVGDKVMKPAHVKGTIDNADLA
KLAFKRSSKYDLECAQIPVHMKSDASKFTHEKPEGYYNWHHGAVQYSGGRFTIPTGAGKPGDSGRPIFDNKGRVV
AIVLGGANEGARTALSVVTWNKDIVTKITPEGAEEWSLAIPVMCLLANTTFPCSQPPCTPCCYEKEPEETLRMLE
DNVMRPGYYQLLQASLTCSPHRQRRSTKDNFNVYKATRPYLAHCPDCGEGHSCHSPIALERIRNEATDGTLKIQV
SLQIGIKTDDSHDWTKLRYMDSHTPADAERAGLLVRTSAPCTITGTMGHFILARCPKGETLTVGFTDSRKISHTC
THPFHHEPPVIGRERFHSRPQHGKELPCSTYVQSTAATAEEIEVHMPPDTPDRTLMTQQSGNVKITVNGQTVRYK
CNCGGSNEGLTTTDKVINNCKIDQCHAAVTNHKNWQYNSPLVPRNAELGDRKGKIHIPFPLANVTCRVPKARNPT
VTYGKNQVTMLLYPDHPTLLSYRNMGQEPNYHEEWVTHKKEVTLTVPTEGLEVTWGNNEPYKYWPQMSTNGTAHG
HPHEIILYYYELYPTMTVVIVSVASFVLLSMVGTAVGMCVCARRRCITPYELTPGATVPFLLSLLCCVRTTKAAT
YQEAAIYLWNEQQPLFWLQALIPLAALIVLCNCLRLLPCCCKTLAFLAVMSVGAHTVSAYEHVTVIPNTVGVPYK
TLVNRPGYSPMVLEMELLSVTLEPTLSLDYITCEYKTVIPSPYVKCCGTAECKDKNLPDYSCKVFTGVYPFMWGG
AYCFCDAENTQLSEAHVEKSESCKTEFASAYRAHTASASAKLRVLYQGNNITVTAYANGDHAVTVKDAKFIVGPM
SSAWTPFDNKIVVYKGDVYNMDYPPFGAGRPGQFGDIQSRTPESKDVYANTQLVLQRPAVGTVHVPYSQAPSGFK
YWLKERGASLQHTAPFGCQIATNPVRAVNCAVGNMPISIDIPEAAFTRVVDAPSLTDMSCEVPACTHSSDFGGVA
IIKYAASKKGKCAVHSMTNAVTIREAEIEVEGNSQLQISFSTALASAEFRVQVCSIQVHCAAECHPPKDHIVNYP
ASHTTLGVQDISATAMSWVQKITGGVGLVVAVAALILIVVLCVSFSRH

Figure 34A

CMV/R-CHIKV C-E3-6K-E2-E1 (Strain OPY1) 5'E2(strain 37997)

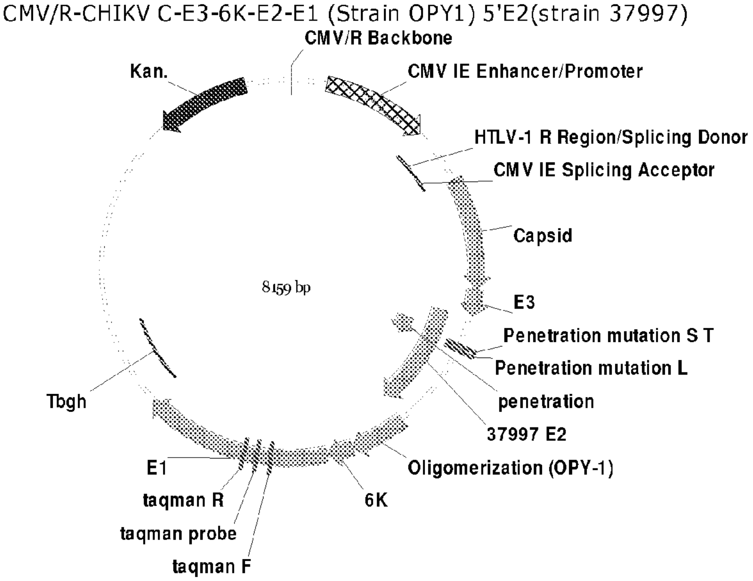

Figure 34B

Insert sequence atggagttcatcccaacccaaacttttacaataggaggtaccagcctcgaccctggactccgcgccctactatc
caagtcatcaggcccagaccgcgccctcagaggcaagctgggcaacttgcccagctgatctcagcagttaataaa
ctgacaatgcgcgcggtaccacaacagaagccacgcaggaatcggaagaataagaagcaaaagcaaaaacaacag
gcgccacaaaacaacacaaatcaaaagaagcagccacctaaaaagaaaccggctcaaaagaaaaagaagccgggc
cgcagagagaggatgtgcatgaaaatcgaaaatgattgtattttcgaagtcaagcacgaaggtaaggtaacaggt
tacgcgtgcctggtgggggacaaagtaatgaaaccagcacacgtaaaggggaccatcgataacgcggacctggcc
aaactggcctttaagcggtcatctaagtatgaccttgaatgcgcgcagatacccgtgcacatgaagtccgacgct
tcgaagttcacccatgagaaaccggaggggtactacaactggcaccacggagcagtacagtactcaggaggccgg
ttcaccatccctacaggtgctggcaaaccaggggacagcggcagaccgatcttcgacaacaagggacgcgtggtg
gccatagtcttaggaggagctaatgaaggagcccgtacagccctctcggtggtgacctggaataaagacattgtc
actaaaatcacccccgaggggggccgaagagtggagtcttgccatcccagttatgtgcctgttggcaaacaccacg
ttcccctgctcccagccccccttgcacgccctgctgctacgaaaaggaaccggaggaaaccctacgcatgcttgag
gacaacgtcatgagacctgggtactatcagctgctacaagcatccttaacatgttctccccaccgccagcgacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccacccaacactcctgtcctaccggaatatg
ggagaagaaccaaactatcaagaagagtgggtgatgcataagaaggaagtcgtgctaaccgtgccgactgaaggg
ctcgaggtcacgtggggcaacaacgagccgtataagtattggccgcagttatctacaaacggtacagcccatggc
cacccgcatgagataattctgtattattatgagctgtaccccactatgactgtagtagttgtgtcagtggccacg
ttcatactcctgtcgatggtgggtatggcagcggggatgtgcatgtgtgcacgacgcagatgcatcacaccgtat

Figure 34B continued gaactgacaccaggagctaccgtccctttcctgcttagcctaatatgctgcatcagaacagctaaagcggccaca
taccaagaggctgcgatatacctgtggaacgagcagcaacctttgttttggctacaagcccttattccgctggca
gccctgattgttctatgcaactgtctgagactcttaccatgctgctgtaaaacgttggctttttagccgtaatg
agcgtcggtgcccacactgtgagcgcgtacgaacacgtaacagtgatcccgaacacggtgggagtaccgtataag
actctagtcaatagacctggctacagccccatggtattggagatggaactactgtcagtcactttggagccaaca
ctatcgcttgattacatcacgtgccgagtacaaaaccgtcatcccgtctccgtacgtgaagtgctgcggtacagca
gagtgcaaggacaaaaacctacctgactacagctgtaaggtcttcaccggcgtctacccatttatgtggggcggc
gcctactgcttctgcgacgctgaaaacacgcagttgagcgaagcacacgtggagaagtccgaatcatgcaaaaca
gaatttgcatcagcatacagggctcataccgcatctgcatcagctaagctccgcgtcctttaccaaggaaataac
atcactgtaactgcctatgcaaacggcgaccatgccgtcacagttaaggacgccaaattcattgtggggccaatg
tcttcagcctggacacctttcgacaacaaaattgtggtgtacaaaggtgacgtctataacatggactacccgccc
tttggcgcaggaagaccaggacaatttggcgatatccaaagtcgcacacctgagagtaaagacgtctatgctaat
acacaactggtactgcagagaccggctgtgggtacggtacacgtgccatactctcaggcaccatctggctttaag
tattggctaaaagaacgcggggcgtcgctgcagcacacagcaccatttggctgccaaatagcaacaaacccggta
agagcggtgaactgcgccgtagggaacatgcccatctccatcgacataccggaagcggccttcactagggtcgtc
gacgcgccctctttaacggacatgtcgtgcgaggtaccagcctgcacccattcctcagactttgggggcgtcgcc
attattaaatatgcagccagcaagaaaggcaagtgtgcggtgcattcgatgactaacgccgtcactattcggaa
gctgagatagaagttgaagggaattctcagctgcaaatctctttctcgacggccttagccagcgccgaattccgc
gtacaagtctgttctacacaagtacactgtgcagccgagtgccacccccgaaggaccacatagtcaactacccg
gcgtcacataccaccctcggggtccaggacatctccgctacggcgatgtcatgggtgcagaagatcacggaggt
gtgggactggttgttgctgttgccgcactgattctaatcgtggtgctatgcgtgtcgttcagcaggcac Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccaacccaaactttttacaataggaggtac
cagcctcgaccctggactccgcgccctactatccaagtcatcaggcccagaccgcgccctcagaggcaagctggg
caacttgcccagctgatctcagcagttaataaactgacaatgcgcgcggtaccacaacagaagccacgcaggaat
cggaagaataagaagcaaaagcaaaaacaacaggcgccacaaaacaacacaaatcaaaagaagcagccacctaaa
aagaaaccggctcaaaagaaaaagaagccgggccgcagagagaggatgtgcatgaaaatcgaaaatgattgtatt
ttcgaagtcaagcacgaaggtaaggtaacaggttacgcgtgcctggtgggggacaaagtaatgaaaccagcacac
gtaaaggggaccatcgataacgcggacctggccaaactggcctttaagcggtcatctaagtatgaccttgaatgc
gcgcagatacccgtgcacatgaagtccgacgcttcgaagttcacccatgagaaaccggaggggtactacaactgg
caccacggagcagtacagtactcaggaggccggttcaccatccctacaggtgctggcaaaccaggggacagcggc
agaccgatcttcgacaacaagggacgcgtggtggccatagtcttaggaggagctaatgaaggagcccgtacagcc
ctctcggtggtgacctggaataaagacattgtcactaaaatcacccccgaggggggccgaagagtggagtcttgcc
atcccagttatgtgcctgttggcaaacaccacgttcccctgctcccagcccccttgcacgccctgctgctacgaa
aaggaaccggaggaaaccctacgcatgcttgaggacaacgtcatgagacctgggtactatcagctgctacaagca
tccttaacatgttctccccaccgccagcgacgcagtactaaggacaattttaatgtctataaagccacaagacca

Figure 34B continued tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccacccaacactcctgtcctaccggaatatgggagaagaaccaaactatcaagaagagtgggtgatgcataag
aaggaagtcgtgctaaccgtgccgactgaagggctcgaggtcacgtggggcaacaacgagccgtataagtattgg
ccgcagttatctacaaacggtacagcccatggccacccgcatgagataattctgtattattatgagctgtacccc
actatgactgtagtagttgtgtcagtggccacgttcatactcctgtcgatggtgggtatggcagcggggatgtgc
atgtgtgcacgacgcagatgcatcacaccgtatgaactgacaccaggagctaccgtccctttcctgcttagccta
atatgctgcatcagaacagctaaagcggccacataccaagaggctgcgatatacctgtggaacgagcagcaacct
ttgttttggctacaagcccttattccgctggcagccctgattgttctatgcaactgtctgagactcttaccatgc
tgctgtaaaacgttggctttttagccgtaatgagcgtcggtgcccacactgtgagcgcgtacgaacacgtaaca
gtgatcccgaacacggtgggagtaccgtataagactctagtcaatagacctggctacagccccatggtattggag
atggaactactgtcagtcactttggagccaacactatcgcttgattacatcacgtgcgagtacaaaaccgtcatc
ccgtctccgtacgtgaagtgctgcggtacagcagagtgcaaggacaaaaacctacctgactacagctgtaaggtc
ttcaccggcgtctacccatttatgtggggcggcgcctactgcttctgcgacgctgaaaacacgcagttgagcgaa
gcacacgtggagaagtccgaatcatgcaaaacagaatttgcatcagcatacagggctcataccgcatctgcatca
gctaagctccgcgtcctttaccaaggaaataacatcactgtaactgcctatgcaaacggcgaccatgccgtcaca
gttaaggacgccaaattcattgtggggccaatgtcttcagcctggacacctttcgacaacaaaattgtggtgtac
aaaggtgacgtctataacatggactacccgccctttggcgcaggaagaccaggacaatttggcgatatccaaagt
cgcacacctgagagtaaagacgtctatgctaatacacaactggtactgcagagaccggctgtgggtacggtacac
gtgccatactctcaggcaccatctggctttaagtattggctaaaagaacgcggggcgtcgctgcagcacacagca
ccatttggctgccaaatagcaacaaacccggtaagagcggtgaactgcgccgtagggaacatgcccatctccatc
gacataccggaagcggccttcactagggtcgtcgacgcgccctctttaacggacatgtcgtgcgaggtaccagcc
tgcacccattcctcagactttgggggcgtcgccattattaaatatgcagccagcaagaaaggcaagtgtgcggtg
cattcgatgactaacgccgtcactattcgggaagctgagatagaagttgaagggaattctcagctgcaaatctct
ttctcgacggccttagccagcgccgaattccgcgtacaagtctgttctacacaagtacactgtgcagccgagtgc
cacccccgaaggaccacatagtcaactacccggcgtcacataccaccctcggggtccaggacatctccgctacg
gcgatgtcatgggtgcagaagatcacgggaggtgtgggactggttgttgctgttgccgcactgattctaatcgtg
gtgctatgcgtgtcgttcagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaaggggggaggat
tgggaagacaatagcaggcatgctggggatgcggtgggctctatggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcgggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaactttgctttgcca
cggaacggtctgcgttgtcgggaagatgcgtgatctgatccttcaactcagcaaaagttcgatttattcaacaaa

Figure 34B continued gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 34C

Translation of CMV/R-CHIKV C-E3-6K-E2-E1 (Strain OPY1) 5'E2(strain 37997)

1248 aa

MEFIPTQTFYNRRYQPRPWTPRPTIQVIRPRPRPQRQAGQLAQLISAVNKLTMRAVPQQKPRRNRKNKKQKQKQQ
APQNNTNQKKQPPKKKPAQKKKKPGRRERMCMKIENDCIFEVKHEGKVTGYACLVGDKVMKPAHVKGTIDNADLA
KLAFKRSSKYDLECAQIPVHMKSDASKFTHEKPEGYYNWHHGAVQYSGGRFTIPTGAGKPGDSGRPIFDNKGRVV
AIVLGGANEGARTALSVVTWNKDIVTKITPEGAEEWSLAIPVMCLLANTTFPCSQPPCTPCCYEKEPEETLRMLE
DNVMRPGYYQLLQASLTCSPHRQRRSTKDNFNVYKATRPYLAHCPDCGEGHSCHSPIALERIRNEATDGTLKIQV
SLQIGIKTDDSHDWTKLRYMDSHTPADAERAGLLVRTSAPCTITGTMGHFILARCPKGETLTVGFTDSRKISHTC
THPFHHEPPVIGRERFHSRPQHGKELPCSTYVQSTAATAEEIEVHMPPDTPDRTLMTQQSGNVKITVNGQTVRYK
CNCGGSNEGLTTTDKVINNCKIDQCHAAVTNHKNWQYNSPLVPRNAELGDRKGKIHIPFPLANVTCRVPKARNPT
VTYGKNQVTMLLYPDHPTLLSYRNMGEEPNYQEEWVMHKKEVVLTVPTEGLEVTWGNNEPYKYWPQLSTNGTAHG
HPHEIILYYYELYPTMTVVVVSVATFILLSMVGMAAGMCMCARRRCITPYELTPGATVPFLLSLICCIRTAKAAT
YQEAAIYLWNEQQPLFWLQALIPLAALIVLCNCLRLLPCCCKTLAFLAVMSVGAHTVSAYEHVTVIPNTVGVPYK
TLVNRPGYSPMVLEMELLSVTLEPTLSLDYITCEYKTVIPSPYVKCCGTAECKDKNLPDYSCKVFTGVYPFMWGG
AYCFCDAENTQLSEAHVEKSESCKTEFASAYRAHTASASAKLRVLYQGNNITVTAYANGDHAVTVKDAKFIVGPM
SSAWTPFDNKIVVYKGDVYNMDYPPFGAGRPGQFGDIQSRTPESKDVYANTQLVLQRPAVGTVHVPYSQAPSGFK
YWLKERGASLQHTAPFGCQIATNPVRAVNCAVGNMPISIDIPEAAFTRVVDAPSLTDMSCEVPACTHSSDFGGVA
IIKYAASKKGKCAVHSMTNAVTIREAEIEVEGNSQLQISFSTALASAEFRVQVCSTQVHCAAECHPPKDHIVNYP
ASHTTLGVQDISATAMSWVQKITGGVGLVVAVAALILIVVLCVSFSRH

Mutant in ASR and Capsid in EEEV Improves VLP Yield

A. C-Env | C | E3 | E2 | 6K | E1 |

EEEV: KRKK: *NLS motif*
67

B.

E2 R239N | C K67N, E2 R239N

Fraction: 1 2 3 4 5 6 7 | 1 2 3 4 5 6 7

50 –
37 – ← E1/E2
25 – ← Capsid

Mutant in Capsid in WEEV Improves VLP Yield

A. C-Env | C | E3 | E2 | 6K | E1 |

CHIKV: NKKQ
WEEV: KKKK: *NLS motif*
67

B. WT, K67N, K67N K68N, K67N K68N K69N

← E1/E2

← Capsid

Mutant in Capsid in VEEV Improves VLP Yield

A. C-Env | C | E3 | E2 | 6K | E1 |

VEEV: KKPKK: *NLS motif*
64

B. Control, WT, K64N, K64N K65N, K65N K67N, K65A K67A, K65A K67N, K65N K67A

← E1/E2
← Capsid

Mutant in Capsid in VEEV Improves VLP Yield

A. C-Env | C | E3 | E2 | 6K | E1 |

VEEV: KKPKK: *NLS motif*
64

B.

VEEV WT / C K64N
Fraction: 1 2 3 4 5 6 7  1 2 3 4 5 6 7

50 — ← E1/E2
37 —
25 — ← Capsid

Figure 40A

CMV/R WEEV CBA87 strain capsid K67N VLP

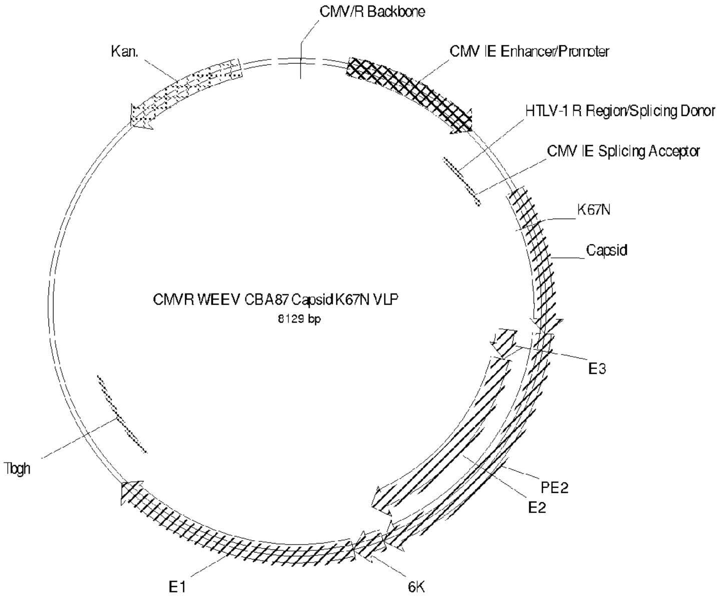

Figure 40B
Capsid insert sequence atgtttccataccctcagctgaactttccaccagtttaccctacaaatccgatggcttaccgagatccaaaccct
cctaggcgccgctggaggccgtttcggcccccgctggctgctcaaatcgaagatcttaggaggtcgatagccaac
ttaactttcaaacaacgagcacctaatccgccgccaggtccgccgccgaataagaagaagagtgctcccaaacca
aaacctactcagcctaaaaagaagaagcaacaagccaagaagacgaaacgcaagcctaaaccagggaaacgacag
cgtatgtgtatgaagttggagtcggacaagacgtttccgatcatgttgaacggccaagtgaatggatacgcttgc
gttgtcggaggaaggctgatgaaaccactccacgttgaaggaaaaatcgataatgagcaattagcggccgtgaaa
ttgaagaaggctagcatgtacgacctggagtatggcgacgttccccagaatatgaaatcagacacgctgcagtac
accagcgacaaaccaccgggcttctacaactggcaccacggcgcagtccagtatgagaatggagattcaccgta
ccgcgaggagtggcgggaaaggcgacagtggaagaccgatcctggacaacagaggcagagttgtggctattgtt
ctaggaggtgcaaacgagggcacacgtacggcgctttcagtggtcacttggaaccagaaaggggtgaccatcaag
gatacccccgaaggttctgaaccgtgg Figure 40C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga

Figure 40C continued ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttccatacccctcagctgaactttccaccagtttaccctacaaat
ccgatggcttaccgagatccaaaccctcctaggcgccgctggaggccgtttcggccccccgctggctgctcaaatc
gaagatcttaggaggtcgatagccaacttaactttcaaacaacgagcacctaatccgccgccaggtccgccgccg
aataagaagaagagtgctcccaaaccaaaacctactcagcctaaaaagaagaagcaacaagccaagaagacgaaa
cgcaagcctaaaccagggaaacgacagcgtatgtgtatgaagttggagtcggacaagacgtttccgatcatgttg
aacggccaagtgaatggatacgcttgcgttgtcggaggaaggctgatgaaaccactccacgttgaaggaaaaatc
gataatgagcaattagcggccgtgaaattgaagaaggctagcatgtacgacctggagtatggcgacgttccccag
aatatgaaatcagacacgctgcagtacaccagcgacaaaccaccgggcttctacaactggcaccacggcgcagtc
cagtatgagaatgggagattcaccgtaccgcgaggagtgggcgggaaaggcgacagtggaagaccgatcctggac
aacagaggcagagttgtggctattgttctaggaggtgcaaacgagggcacacgtacggcgctttcagtggtcact
tggaaccagaaaggggtgaccatcaaggatacccccgaaggttctgaaccgtggtcactagttacagcgctgtgc
gtgctttcgaatgtcacattcccttgcgacaaaccacccgtgtgctattcactggcgccagaacgaacactcgac
gtgctcgaggagaacgtcgacaatccaaattacgacacgctgctggagaacgtcttgaaatgtccatcacgccgg
cccaaacgaagcattaccgatgacttcacgctgaccagtccctacctggggttctgcccgtattgcagacactca
gcgccatgttttagcccaataaaaattgagaacgtgtgggacgaatctgatgatgggtcgattagaatccaggtc
tcggcacaattcggctacaatcaggcaggcactgcagacgtcaccaagttccggtacatgtcttacgaccacgac
catgacatcaaggaagacagtatggagaaattagctattagtacatccggaccatgccgtcgtcttggccacaaa
gggtacttcctgttagctcaatgtcctccaggtgacagtgtaaccgtcagtatcacgagcggagcatctgagaat
tcatgcaccgtggagaaaaagatcaggaggaagtttgtcggtagagaggagtacttgttcccacctgtccatgga
aagctggtaaagtgccacgtttacgatcacttgaaggagacgtctgccggatatataactatgcacaggccaggc
ccacacgcgtataagtcctacctggaggaagcgtcaggcgaagtgtacattaaaccaccttctggcaagaacgtc
acctacgaatgtaagtgtggtgactacagcacaggtattgtgagcacgcgaacgaagatgaacggctgcactaaa
gcaaaacaatgcattgcctacaagcgcgaccaaacgaaatgggtcttcaactcgccggatcttattaggcacaca
gaccactcagtgcaaggtaaactgcacattccattccgcttgacaccgacagtctgcccggttccgttagctcac
acgcctacagtcacgaagtggttcaaaggcatcaccctccacctgactgcaacgcgaccaacattgctgacaacg
agaaaattggggctgcgagcagacgcaacagcagaatggattacggggactacatccaggaatttttctgtgggg
cgagaagggctggagtacgtatggggcaaccatgaaccagtcagagtctgggcccaggagtcggcaccaggcgac
ccgcatggatggccgcatgagatcatcatccattattatcatcggcatccagtctacactgtcattgtgctgtgc
ggtgtcgctctggctatcctggtaggcactgcatcgtcagcagcttgtatcgccaaagcaagaagagactgcctg
acgccatacgcgcttgcaccgaacgcaacggtacccacagcattagcagttttgtgctgtattcggccaaccaac
gctgaaacatttggagaaactttgaatcatctgtggtttaacaaccaaccgtttctctgggcacagttgtgcatc
cctctggcagcgcttattattctgttccgctgcttttcatgctgcatgcctttttattggttgcaggcgtctgc
ctggggaaggtagacgccttcgaacatgcgaccactgtgccaaatgttccggggatcccgtataaggcgttggtc
gaacgtgcaggttacgcgccacttaatctggagattacggtcgtctcatcggaattaacaccctcaactaacaag
gagtacgtgacctgcaaatttcacacagtcgttccttcaccacaagttaaatgctgcgggtccctcgagtgtaag
gcatcctcaaaagcggattacacatgccgcgtttttggcggtgtgtaccctttcatgtggggaggcgcacagtgc
ttctgtgacagtgagaacacacaactgagtgaggcatacgtcgagttcgctccagactgcactatagatcatgca
gtcgcactaaaagttcacacagctgctctgaaagtcggcctgcgtatagtatacggcaataccacagcgcgcctg
gatacattcgtcaacggcgtcacaccaggttcctcacgggacctgaaggtcatagcagggccgatatcagcagct
tttcaccctttgaccataaggtcgtcattagaaagggcttgtttacaactacgacttccctgagtatggagct
atgaacccaggagcgttcggcgatattcaagcatcctctcttgatgccacagacatagtagcccgcaccgacata
cggctgctgaagccttctgtcaagaacatccacgtcccctacacccaagcagtatcagggtatgaaatgtggaag
aacaactcaggacgacccctgcaagaaacagcaccattcggatgtaaaattgaagtggagcctctgcgagcgact
aactgtgcttatgggcacatccctatctcgattgacatccctgatgcagcttttgtgagatcatctgaatcacca
acaattttagaagtcagctgcacagtagcagactgcatttattctgcagactttggtggttcgctaacactacag
tacaaagctaacagagagggacattgtccagttcactcccactccactacagctgttttgaaggaagcgaccaca
catgtgactgccacaggcagcataacactacattttagcacatcgagcccacaagcaaatttcatagtttcgcta
tgcggcaagaagaccacctgcaatgctgaatgtaaaccaccggccgaccacataattggagaaccacataaggtc
gaccaagaattccaggcggcagtttccaaaacatcttggaactggctgcttgcactgtttggggagcatcatcc
ctcattgttgtaggacttatagtgttggtctgcagctctatgcttataaacacacgtagatgatctagaccaggc
cctggatccagatctgctgtgccttctagttgccagccatctgttgtttgcccctcccccgtgccttccttgacc
ctggaaggtgccactcccactgtcctttcctaataaaatgaggaaattgcatcgcattgtctgagtaggtgtcat
tctattctggggggtggggtggggcaggacagcaagggggaggattgggaagacaatagcaggcatgctggggat
gcggtgggctctatgggtacccaggtgctgaagaattgacccggttcctcctgggccagaaagaagcaggcacat
ccccttctctgtgacacaccctgtccacgcccctggttcttagttccagccccactcataggacactcatagctc
aggagggctccgccttcaatcccacccgctaaagtacttggagcggtctctccctccctcatcagcccaccaaac

Figure 40C continued caaacctagcctccaagagtgggaagaaattaaagcaagataggctattaagtgcagagggagagaaaatgcctc
caacatgtgaggaagtaatgagagaaatcatagaattttaaggccatgatttaaggccatcatggccttaatctt
ccgcttcctcgctcactgactcgctgcgctcggtcgttcggctgcggcgagcggtatcagctcactcaaaggcgg
taatacggttatccacagaatcaggggataacgcaggaaagaacatgtgagcaaaaggccagcaaaaggccagga
accgtaaaaaggccgcgttgctggcgtttttccataggctccgcccccctgacgagcatcacaaaaatcgacgct
caagtcagaggtggcgaaacccgacaggactataaagataccaggcgtttccccctggaagctccctcgtgcgct
ctcctgttccgaccctgccgcttaccggatacctgtccgcctttctcccttcgggaagcgtggcgctttctcata
gctcacgctgtaggtatctcagttcggtgtaggtcgttcgctccaagctgggctgtgtgcacgaaccccccgttc
agcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggccta
actacggctacactagaagaacagtatttggtatctgcgctctgctgaagccagttaccttcggaaaaagagttg
gtagctcttgatccggcaaacaaaccaccgctggtagcggtggtttttttgtttgcaagcagcagattacgcgca
gaaaaaaaggatctcaagaagatcctttgatcttttctacggggtctgacgctcagtggaacgaaaactcacgtt
aagggattttggtcatgagattatcaaaaaggatcttcacctagatccttttaaattaaaaatgaagttttaaat
caatctaaagtatatatgagtaaacttggtctgacagttaccaatgcttaatcagtgaggcacctatctcagcga
tctgtctatttcgttcatccatagttgcctgactcgggggggggggcgctgaggtctgcctcgtgaagaaggtg
ttgctgactcataccaggcctgaatcgccccatcatccagccagaaagtgagggagccacggttgatgagagctt
tgttgtaggtggaccagttggtgattttgaacttttgctttgccacggaacggtctgcgttgtcgggaagatgcg
tgatctgatccttcaactcagcaaaagttcgatttattcaacaaagccgccgtcccgtcaagtcagcgtaatgct
ctgccagtgttacaaccaattaaccaattctgattagaaaaactcatcgagcatcaaatgaaactgcaatttatt
catatcaggattatcaataccatatttttgaaaaagccgtttctgtaatgaaggagaaaactcaccgaggcagtt
ccataggatggcaagatcctggtatcggtctgcgattccgactcgtccaacatcaatacaacctattaatttccc
ctcgtcaaaaataaggttatcaagtgagaaatcaccatgagtgacgactgaatccggtgagaatggcaaaagctt
atgcatttctttccagacttgttcaacaggccagccattacgctcgtcatcaaaatcactcgcatcaaccaaacc
gttattcattcgtgattgcgcctgagcgagacgaaatacgcgatcgctgttaaaaggacaattacaaacaggaat
cgaatgcaaccggcgcaggaacactgccagcgcatcaacaatattttcacctgaatcaggatattcttctaatac
ctggaatgctgttttcccggggatcgcagtggtgagtaaccatgcatcatcaggagtacggataaaatgcttgat
ggtcggaagaggcataaattccgtcagccagtttagtctgaccatctcatctgtaacatcattggcaacgctacc
tttgccatgtttcagaaacaactctggcgcatcgggcttcccatacaatcgatagattgtcgcacctgattgccc
gacattatcgcgagcccatttatacccatataaatcagcatccatgttggaatttaatcgcggcctcgagcaaga
cgtttcccgttgaatatggctcataacaccccttgtattactgtttatgtaagcagacagttttattgttcatga
tgatatatttttatcttgtgcaatgtaacatcagagattttgagacacaacgtggctttcccccccccccccatta
ttgaagcatttatcagggttattgtctcatgagcggatacatatttgaatgtatttagaaaaataaacaaatagg
ggttccgcgcacatttccccgaaaagtgccacctgacgtctaagaaaccattattatcatgacattaacctataa
aaataggcgtatcacgaggccctttcgtc Figure 40D
AA sequence mfpypqlnfppvyptnpmayrdpnpprrrwrpfrpplaaqiedlrrsianltfkqrapnpppgpppnkkksapkp
kptqpkkkkqqakktkrkpkpgkrqrmcmklesdktfpimlngqvngyacvvggrlmkplhvegkidneqlaavk
lkkasmydleygdvpqnmksdtlqytsdkppgfynwhhgavqyengrftvprgvggkgdsgrpildnrgrvvaiv
lgganegtrtalsvvtwnqkgvtikdtpegsepwslvtalcvlsnvtfpcdkppvcyslapertldvleenvdnp
nydtllenvlkcpsrrpkrsitddftltspylgfcpycrhsapcfspikienvwdesddgsiriqvsaqfgynqa
gtadvtkfrymsydhdhdikedsmeklaistsgpcrrlghkgyfllaqcppgdsvtvsitsgasensctvekkir
rkfvgreeylfppvhgklvkchvydhlketsagyitmhrpgphayksyleeasgevyikppsgknvtyeckcgdy
stgivstrtkmngctkakqciaykrdqtkwvfnspdlirhtdhsvqgklhipfrltptvcpvplahtptvtkwfk
gitlhltatrptllttrklglradataewitgttsrnfsvgregleyvwgnhepvrvwaqesapgdphgwpheii
ihyyhrhpvytvivlcgvalailvgtassaaciakarrdcltpyalapnatvptalavlccirptnaetfgetln
hlwfnnqpflwaqlciplaaliilfrcfsccmpfllvagvclgkvdafehattvpnvpgipykalveragyapln
leitvvsseltpstnkeyvtckfhtvvpspqvkccgsleckasskadytcrvfggvypfmwggaqcfcdsentql
seayvefapdctidhavalkvhtaalkvglrivygnttarldtfvngvtpgssrdlkviagpisaafspfdhkvv
irkglvynydfpeygamnpgafgdiqassldatdivartdirllkpsvknihvpytqavsgyemwknnsgrplqe
tapfgckieveplratncayghipisidipdaafvrssesptilevsctvadciysadfggsltlqykanreghc
pvhshsttavlkeatthvtatgsitlhfstsspqanfivslcgkkttcnaeckppadhiigephkvdqefqaavs
ktswnwllalfggasslivvglivlvcssmlintrr

Figure 41A

CMV/R WEEV CBA87 strain capsid K67N K68N VLP

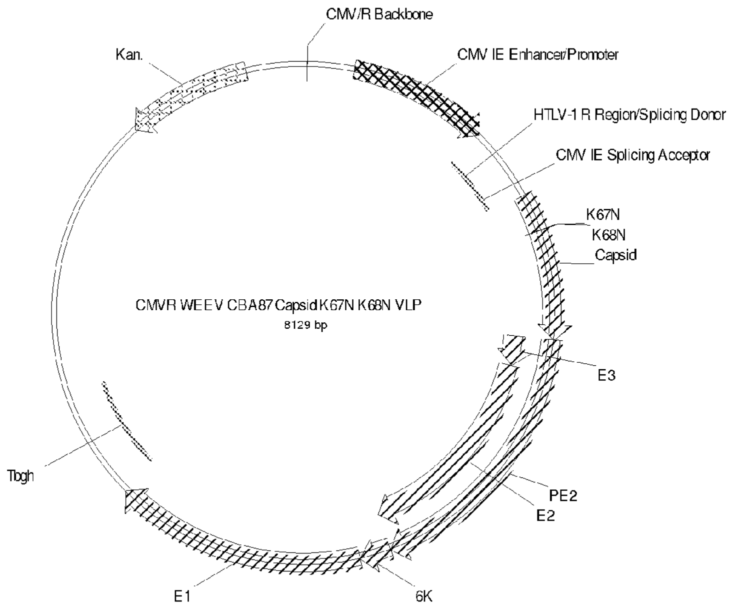

Figure 41B
Capsid insert atgtttccataccctcagctgaactttccaccagtttaccctacaaatccgatggcttaccgagatccaaaccct
cctaggcgccgctggaggccgtttcggcccccgctggctgctcaaatcgaagatcttaggaggtcgatagccaac
ttaactttcaaacaacgagcacctaatccgccgccaggtccgccgccgaataataagaagagtgctcccaaacca
aaacctactcagcctaaaaagaagaagcaacaagccaagaagacgaaacgcaagcctaaaccagggaaacgacag
cgtatgtgtatgaagttggagtcggacaagacgtttccgatcatgttgaacggccaagtgaatggatacgcttgc
gttgtcggaggaaggctgatgaaaccactccacgttgaaggaaaaatcgataatgagcaattagcggccgtgaaa
ttgaagaaggctagcatgtacgacctggagtatggcgacgttccccagaatatgaaatcagacacgctgcagtac
accagcgacaaaccaccgggcttctacaactggcaccacggcgcagtccagtatgagaatggagattcaccgta
ccgcgaggagtgggcgggaaaggcgacagtggaagaccgatcctggacaacagaggcagagttgtggctattgtt
ctaggaggtgcaaacgagggcacacgtacggcgctttcagtggtcacttggaaccagaaaggggtgaccatcaag
gatacccccgaaggttctgaaccgtgg Figure 41C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag

Figure 41C continued agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttccataccctcagctgaactttccaccagtttaccctacaaat
ccgatggcttaccgagatccaaaccctcctaggcgccgctggagccgtttcggccccgctggctgctcaaatc
gaagatcttaggaggtcgatagccaacttaactttcaaacaacgagcacctaatccgccgccaggtccgccgccg
aataataagaagagtgctcccaaaccaaaacctactcagcctaaaaagaagaagcaacaagccaagaagacgaaa
cgcaagcctaaaccagggaaacgacagcgtatgtgtatgaagttggagtcggacaagacgtttccgatcatgttg
aacggccaagtgaatggatacgcttgcgttgtcggaggaaggctgatgaaaccactccacgttgaaggaaaaatc
gataatgagcaattagcggccgtgaaattgaagaaggctagcatgtacgacctggagtatggcgacgttccccag
aatatgaaatcagacacgctgcagtacaccagcgacaaaccaccgggcttctacaactggcaccacggcgcagtc
cagtatgagaatgggagattcaccgtaccgcgaggagtgggcgggaaaggcgacagtggaagaccgatcctggac
aacagaggcagagttgtggctattgttctaggaggtgcaaacgagggcacacgtacggcgctttcagtggtcact
tggaaccagaaaggggtgaccatcaaggataccccgaaggttctgaaccgtggtcactagttacagcgctgtgc
gtgctttcgaatgtcacattcccttgcgacaaaccacccgtgtgctattcactggcgccagaacgaacactcgac
gtgctcgaggagaacgtcgacaatccaaattacgacacgctgctggagaacgtcttgaaatgtccatcacgccgg
cccaaacgaagcattaccgatgacttcacgctgaccagtccctacctggggttctgcccgtattgcagacactca
gcgccatgttttagcccaataaaaattgagaacgtgtgggacgaatctgatgatgggtcgattagaatccaggtc
tcggcacaattcggctacaatcaggcaggcactgcagacgtcaccaagttccggtacatgtcttacgaccacgac
catgacatcaaggaagacagtatggagaaattagctattagtacatccggaccatgccgtcgtcttggccacaaa
gggtacttcctgttagctcaatgtcctccaggtgacagtgtaaccgtcagtatcacgagcggagcatctgagaat
tcatgcaccgtggagaaaaagatcaggaggaagtttgtcggtagagaggagtacttgttcccacctgtccatgga
aagctggtaaagtgccacgtttacgatcacttgaaggagacgtctgccggatatataactatgcacaggccaggc
ccacacgcgtataagtcctacctggaggaagcgtcaggcgaagtgtacattaaaccaccttctggcaagaacgtc
acctacgaatgtaagtgtggtgactacagcacaggtattgtgagcacgcgaacgaagatgaacggctgcactaaa
gcaaaacaatgcattgcctacaagcgcgaccaaacgaaatggtcttcaactcgccggatcttattaggcacaca
gaccactcagtgcaaggtaaactgcacattccattccgcttgacaccgacagtctgcccggttccgttagctcac
acgcctacagtcacgaagtggttcaaaggcatcaccctccacctgactgcaacgcgaccaacattgctgacaacg
agaaaattggggctgcgagcagacgcaacagcagaatggattacggggactacatccaggaattttctgtgggg
cgagaagggctggagtacgtatggggcaaccatgaaccagtcagagtctgggcccaggagtcggcaccaggcgac
ccgcatggatggccgcatgagatcatcatccattattatcatcggcatccagtctacactgtcattgtgctgtgc
ggtgtcgctctggctatcctggtaggcactgcatcgtcagcagcttgtatcgccaaagcaagaagagactgcctg
acgccatacgcgcttgcaccgaacgcaacggtacccacagcattagcagttttgtgctgtattcggccaaccaac
gctgaaacatttggagaaactttgaatcatctgtggtttaacaaccaaccgtttctctggcacagttgtgcatc
cctctggcagcgcttattattctgttccgctgcttttcatgctgcatgcctttttattggttgcaggcgtctgc
ctggggaaggtagacgccttcgaacatgcgaccactgtgccaaatgttccggggatcccgtataaggcgttggtc
gaacgtgcaggttacgcgccacttaatctggagattacggtcgtctcatcggaattaacaccctcaactaacaag
gagtacgtgacctgcaaatttcacacagtcgttccttcaccacaagttaaatgctgcgggtccctcgagtgtaag
gcatcctcaaaagcggattacacatgccgcgtttttggcggtgtgtaccctttcatgtggggaggcgcacagtgc
ttctgtgacagtgagaacacacaactgagtgaggcatacgtcgagttcgctccagactgcactatagatcatgca
gtcgcactaaaagttcacacagctgctctgaaagtcggcctgcgtatagtatacggcaataccacagcgcgcctg
gatacattcgtcaacggcgtcacaccaggttcctcacggacctgaaggtcatagcagggccgatatcagcagct
tttcaccctttgaccataaggtcgtcattagaaaggggcttgtttacaactacgacttccctgagtatggagct
atgaacccaggagcgttcggcgatattcaagcatcctctcttgatgccacagacatagtagcccgcaccgacata
cggctgctgaagccttctgtcaagaacatccacgtcccctacacccaagcagtatcaggtatgaaatgtggaag
aacaactcaggacgaccccctgcaagaaacagcaccattcggatgtaaaattgaagtggagcctctgcgagcgact
aactgtgcttatgggcacatccctatctcgattgacatccctgatgcagcttttgtgagatcatctgaatcacca
acaattttagaagtcagctgcacagtagcagactgcatttattctgcagactttggtggttcgctaacactacag
tacaaagctaacagagagggacattgtccagttcactcccactccactacagctgttttgaaggaagcgaccaca
catgtgactgccacaggcagcataacactacattttagcacatcgagcccacaagcaaatttcatagtttcgcta
tgcggcaagaagaccacctgcaatgctgaatgtaaaccaccggccgaccacataattggagaaccacataaggtc
gaccaagaattccaggcggcagtttccaaaacatcttggaactggctgcttgcactgtttggggagcatcatcc
ctcattgttgtaggacttatagtgttggtctgcagctctatgcttataaacacacgtagatgatctagaccaggc
cctggatccagatctgctgtgccttctagttgccagccatctgttgtttgcccctcccccgtgccttccttgacc
ctggaaggtgccactcccactgtcctttcctaataaaatgaggaaattgcatcgcattgtctgagtaggtgtcat
tctattctggggggtggggtggggcaggacagcaagggggaggattgggaagacaatagcaggcatgctggggat
gcggtgggctctatgggtacccaggtgctgaagaattgacccggttcctcctgggccagaaagaagcaggcacat
ccccttctctgtgacacaccctgtccacgcccctggttcttagttccagccccactcataggacactcatagctc

Figure 41C continued aggagggctccgccttcaatcccacccgctaaagtacttggagcggtctctccctccctcatcagcccaccaaac
caaacctagcctccaagagtgggaagaaattaaagcaagataggctattaagtgcagagggagagaaaatgcctc
caacatgtgaggaagtaatgagagaaatcatagaattttaaggccatgatttaaggccatcatggccttaatctt
ccgcttcctcgctcactgactcgctgcgctcggtcgttcggctgcggcgagcggtatcagctcactcaaaggcgg
taatacggttatccacagaatcaggggataacgcaggaaagaacatgtgagcaaaaggccagcaaaaggccagga
accgtaaaaaggccgcgttgctggcgtttttccataggctccgcccccctgacgagcatcacaaaaatcgacgct
caagtcagaggtggcgaaacccgacaggactataaagataccaggcgtttccccctggaagctccctcgtgcgct
ctcctgttccgaccctgccgcttaccggatacctgtccgcctttctcccttcgggaagcgtggcgctttctcata
gctcacgctgtaggtatctcagttcggtgtaggtcgttcgctccaagctgggctgtgtgcacgaaccccccgttc
agcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggccta
actacggctacactagaagaacagtatttggtatctgcgctctgctgaagccagttaccttcggaaaaagagttg
gtagctcttgatccggcaaacaaaccaccgctggtagcggtggtttttttgtttgcaagcagcagattacgcgca
gaaaaaaaggatctcaagaagatcctttgatcttttctacggggtctgacgctcagtggaacgaaaactcacgtt
aagggattttggtcatgagattatcaaaaaggatcttcacctagatccttttaaattaaaaatgaagttttaaat
caatctaaagtatatatgagtaaacttggtctgacagttaccaatgcttaatcagtgaggcacctatctcagcga
tctgtctatttcgttcatccatagttgcctgactcgggggggggggcgctgaggtctgcctcgtgaagaaggtg
ttgctgactcataccaggcctgaatcgccccatcatccagccagaaagtgagggagccacggttgatgagagctt
tgttgtaggtggaccagttggtgattttgaacttttgctttgccacggaacggtctgcgttgtcgggaagatgcg
tgatctgatccttcaactcagcaaaagttcgatttattcaacaaagccgccgtcccgtcaagtcagcgtaatgct
ctgccagtgttacaaccaattaaccaattctgattagaaaaactcatcgagcatcaaatgaaactgcaatttatt
catatcaggattatcaataccatatttttgaaaaagccgtttctgtaatgaaggagaaaactcaccgaggcagtt
ccataggatggcaagatcctggtatcggtctgcgattccgactcgtccaacatcaatacaacctattaatttccc
ctcgtcaaaaataaggttatcaagtgagaaatcaccatgagtgacgactgaatccggtgagaatggcaaaagctt
atgcatttctttccagacttgttcaacaggccagccattacgctcgtcatcaaaatcactcgcatcaaccaaacc
gttattcattcgtgattgcgcctgagcgagacgaaatacgcgatcgctgttaaaaggacaattacaaacaggaat
cgaatgcaaccggcgcaggaacactgccagcgcatcaacaatattttcacctgaatcaggatattcttctaatac
ctggaatgctgttttcccggggatcgcagtggtgagtaaccatgcatcatcaggagtacggataaaatgcttgat
ggtcggaagaggcataaattccgtcagccagtttagtctgaccatctcatctgtaacatcattggcaacgctacc
tttgccatgtttcagaaacaactctggcgcatcgggcttcccatacaatcgatagattgtcgcacctgattgccc
gacattatcgcgagcccatttatacccatataaatcagcatccatgttggaatttaatcgcggcctcgagcaaga
cgtttcccgttgaatatggctcataacacccctgtattactgtttatgtaagcagacagttttattgttcatga
tgatatatttttatcttgtgcaatgtaacatcagagattttgagacacaacgtggctttcccccccccccatta
ttgaagcatttatcagggttattgtctcatgagcggatacatatttgaatgtatttagaaaaataaacaaatagg
ggttccgcgcacatttccccgaaaagtgccacctgacgtctaagaaaccattattatcatgacattaacctataa
aaataggcgtatcacgaggccctttcgtc

Figure 41D

AA sequence of capsid mfpypqlnfppvyptnpmayrdpnpprrrwrpfrpplaaqiedlrrsianltfkqrapnpppgpppnnkksapkp
kptqpkkkkqqakktkrkpkpgkrqrmcmklesdktfpimlngqvngyacvvggrlmkplhvegkidneqlaavk
lkkasmydleygdvpqnmksdtlqytsdkppgfynwhhgavqyengrftvprgvggkgdsgrpildnrgrvvaiv
lgganegtrtalsvvtwnqkgvtikdtpegsepwslvtalcvlsnvtfpcdkppvcyslapertldvleenvdnp
nydtllenvlkcpsrrpkrsitddftltspylgfcpycrhsapcfspikienvwdesddgsiriqvsaqfgynqa
gtadvtkfrymsydhdhdikedsmeklaistsgpcrrlghkgyfllaqcppgdsvtvsitsgasensctvekkir
rkfvgreeylfppvhgklvkchvydhlketsagyitmhrpgphayksyleeasgevyikppsgknvtyeckcgdy
stgivstrtkmngctkakqciaykrdqtkwvfnspdlirhtdhsvqgklhipfrltptvcpvplahtptvtkwfk
gitlhltatrptllttrklglradataewitgttsrnfsvgregleyvwgnhepvrvwaqesapgdphgwpheii
ihyyhrhpvytvivlcgvalailvgtassaaciakarrdcltpyalapnatvptalavlccirptnaetfgetln
hlwfnnqpflwaqlciplaaliilfrcfsccmpfllvagvclgkvdafehattvpnvpgipykalveragyapln
leitvvsseltpstnkeyvtckfhtvvpspqvkccgsleckasskadytcrvfggvypfmwggaqcfcdsentql
seayvefapdctidhavalkvhtaalkvglrivygnttarldtfvngvtpgssrdlkviagpisaafspfdhkvv
irkglvynydfpeygamnpgafgdiqassldatdivartdirllkpsvknihvpytqavsgyemwknnsgrplqe
tapfgckieveplratncayghipisidipdaafvrssesptilevsctvadciysadfggsltlqykanreghc
pvhshsttavlkeatthvtatgsitlhfstsspqanfivslcgkkttcnaeckppadhiigephkvdqefqaavs
ktswnwllalfggassliivvglivlvcssmlintrr

Figure 42A

CMV/R WEEV CBA87 strain capsid K67N K68N K69N VLP

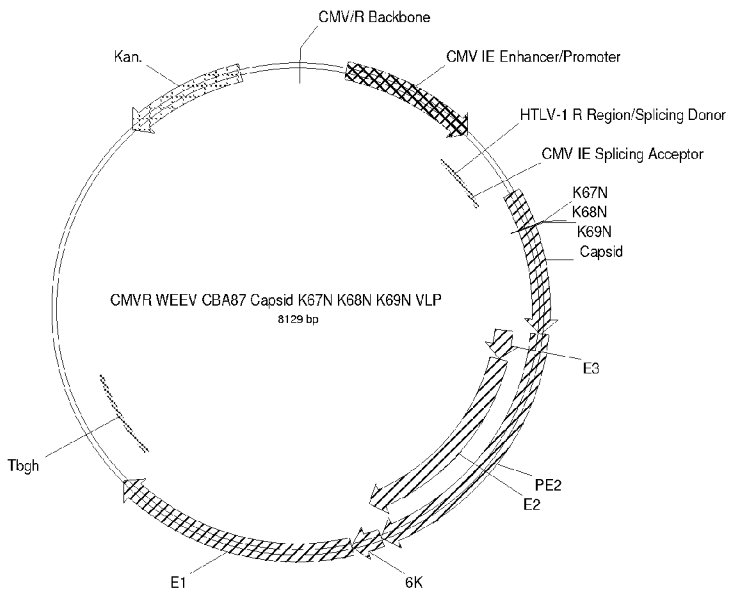

Figure 42B
Capsid insert atgtttccataccctcagctgaactttccaccagtttaccctacaaatccgatggcttaccgagatccaaaccct
cctaggcgccgctggaggccgtttcggcccccgctggctgctcaaatcgaagatcttaggaggtcgatagccaac
ttaactttcaaacaacgagcacctaatccgccgccaggtccgccgccgaataataataagagtgctcccaaacca
aaacctactcagcctaaaaagaagaagcaacaagccaagaagacgaaacgcaagcctaaaccagggaaacgacag
cgtatgtgtatgaagttggagtcggacaagacgtttccgatcatgttgaacggccaagtgaatggatacgcttgc
gttgtcggaggaaggctgatgaaaccactccacgttgaaggaaaaatcgataatgagcaattagcggccgtgaaa
ttgaagaaggctagcatgtacgacctggagtatggcgacgttccccagaatatgaaatcagacacgctgcagtac
accagcgacaaaccaccgggcttctacaactggcaccacggcgcagtccagtatgagaatgggagattcaccgta
ccgcgaggagtgggcgggaaaggcgacagtggaagaccgatcctggacaacagaggcagagttgtggctattgtt
ctaggaggtgcaaacgagggcacacgtacggcgctttcagtggtcacttggaaccagaaaggggtgaccatcaag
gataccccccgaaggttctgaaccgtgg Figure 42C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta

Figure 42C continued cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgtttccataccctcagctgaactttccaccagtttaccctacaaat
ccgatggcttaccgagatccaaaccctcctaggcgccgctggaggccgtttcggccccccgctggctgctcaaatc
gaagatcttaggaggtcgatagccaacttaactttcaaacaacgagcacctaatccgccgccaggtccgccgccg
aataataataagagtgctcccaaaccaaaacctactcagcctaaaaagaagaagcaacaagccaagaagacgaaa
cgcaagcctaaaccagggaaacgacagcgtatgtgtatgaagttggagtcggacaagacgtttccgatcatgttg
aacggccaagtgaatggatacgcttgcgttgtcggaggaaggctgatgaaaccactccacgttgaaggaaaaatc
gataatgagcaattagcggccgtgaaattgaagaacgctagcatgtacgacctggagtatggcgacgttccccag
aatatgaaatcagacacgctgcagtacaccagcgacaaaccaccgggcttctacaactggcaccacggcgcagtc
cagtatgagaatgggagattcaccgtaccgcgaggagtgggcgggaaaggcgacagtggaagaccgatcctggac
aacagaggcagagttgtggctattgttctaggaggtgcaaacgagggcacacgtacggcgctttcagtggtcact
tggaaccagaaagggggtgaccatcaaggatacccccgaaggttctgaaccgtggtcactagttacagcgctgtgc
gtgctttcgaatgtcacattcccttgcgacaaaccacccgtgtgctattcactggcgccagaacgaacactcgac
gtgctcgaggagaacgtcgacaatccaaattacgacacgctgctggagaacgtcttgaaatgtccatcacgccgg
cccaaacgaagcattaccgatgacttcacgctgaccagtccctacctggggttctgcccgtattgcagacactca
gcgccatgttttagcccaataaaaattgagaacgtgtgggacgaatctgatgatgggtcgattagaatccaggtc
tcggcacaattcggctacaatcaggcaggcactgcagacgtcaccaagttccggtacatgtcttacgaccacgac
catgacatcaaggaagacagtatggagaaattagctattagtacatccggaccatgccgtcgtcttggccacaaa
gggtacttcctgttagctcaatgtcctccaggtgacagtgtaaccgtcagtatcacgagcggagcatctgagaat
tcatgcaccgtggagaaaaagatcaggaggaagtttgtcggtagagaggagtacttgttcccacctgtccatgga
aagctggtaaagtgccacgtttacgatcacttgaaggagacgtctgccggatatataactatgcacaggccaggc
ccacacgcgtataagtcctacctggaggaagcgtcaggcgaagtgtacattaaaccaccttctggcaagaacgtc
acctacgaatgtaagtgtggtgactacagcacaggtattgtgagcacgcgaacgaagatgaacggctgcactaaa
gcaaaacaatgcattgcctacaagcgcgaccaaacgaaatgggtcttcaactcgccggatcttattaggcacaca
gaccactcagtgcaaggtaaactgcacattccattccgcttgacaccgacagtctgcccggttccgttagctcac
acgcctacagtcacgaagtggttcaaaggcatcaccctccacctgactgcaacgcgaccaacattgctgacaacg
agaaaattggggctgcgagcagacgcaacagcagaatggattacggggactacatccaggaatttttctgtgggg
cgagaagggctggagtacgtatggggcaaccatgaaccagtcagagtctgggcccaggagtcggcaccaggcgac
ccgcatggatggccgcatgagatcatcatccattattatcatcggcatccagtctacactgtcattgtgctgtgc
ggtgtcgctctggctatcctggtaggcactgcatcgtcagcagcttgtatcgccaaagcaagaagagactgcctg
acgccatacgcgcttgcaccgaacgcaacggtacccacagcattagcagttttgtgctgtattcggccaaccaac
gctgaaacatttggagaaactttgaatcatctgtggtttaacaaccaaccgtttctctgggcacagttgtgcatc
cctctggcagcgcttattattctgttccgctgcttttcatgctgcatgcctttttttattggttgcaggcgtctgc
ctggggaaggtagacgccttcgaacatgcgaccactgtgccaaatgttccggggatcccgtataaggcgttggtc
gaacgtgcaggttacgcgccacttaatctggagattacggtcgtctcatcggaattaacaccctcaactaacaag
gagtacgtgacctgcaaatttcacacagtcgttccttcaccacaagttaaatgctgcgggtccctcgagtgtaag
gcatcctcaaaagcggattacacatgccgcgtttttggcggtgtgtaccctttcatgtggggaggcgcacagtgc
ttctgtgacagtgagaacacacaactgagtgaggcatacgtcgagttcgctccagactgcactatagatcatgca
gtcgcactaaaagttcacacagctgctctgaaagtcggcctgcgtatagtatacggcaataccacagcgcgcctg
gatacattcgtcaacggcgtcacaccaggttcctcacgggacctgaaggtcatagcagggccgatatcagcagct
tttcaccctttgaccataaggtcgtcattagaaaggggcttgtttacaactacgacttccctgagtatggagct
atgaacccaggagcgttcggcgatattcaagcatcctctcttgatgccacagacatagtagcccgcaccgacata
cggctgctgaagccttctgtcaagaacatccacgtcccctacacccaagcagtatcagggtatgaaatgtggaag
aacaactcaggacgacccctgcaagaaacagcaccattcggatgtaaaattgaagtggagcctctgcgagcgact
aactgtgcttatgggcacatccctatctcgattgacatccctgatgcagcttttgtgagatcatctgaatcacca
acaattttagaagtcagctgcacagtagcagactgcatttattctgcagactttggtggttcgctaacactacag
tacaaagctaacagagagggacattgtccagttcactcccactccactacagctgttttgaaggaagcgaccaca
catgtgactgccacaggcagcataacactacattttagcacatcgagcccacaagcaaatttcatagtttcgcta
tgcggcaagaagaccacctgcaatgctgaatgtaaaccaccggccgaccacataattggagaaccacataaggtc
gaccaagaattccaggcggcagtttccaaaacatcttggaactggctgcttgcactgtttggggagcatcatcc
ctcattgttgtaggacttatagtgttggtctgcagctctatgcttataaacacacgtagatgatctagaccaggc
cctggatccagatctgctgtgccttctagttgccagccatctgttgtttgcccctcccccgtgccttccttgacc
ctggaaggtgccactcccactgtcctttcctaataaaatgaggaaattgcatcgcattgtctgagtaggtgtcat

Figure 42C continued tctattctggggggtggggtggggcaggacagcaagggggaggattgggaagacaatagcaggcatgctggggat
gcggtgggctctatgggtacccaggtgctgaagaattgacccggttcctcctgggccagaaagaagcaggcacat
ccccttctctgtgacacaccctgtccacgcccctggttcttagttccagccccactcataggacactcatagctc
aggagggctccgccttcaatcccacccgctaaagtacttggagcggtctctccctccctcatcagcccaccaaac
caaacctagcctccaagagtgggaagaaattaaagcaagataggctattaagtgcagagggagagaaaatgcctc
caacatgtgaggaagtaatgagagaaatcatagaatttaaggccatgatttaaggccatcatggccttaatctt
ccgcttcctcgctcactgactcgctgcgctcggtcgttcggctgcggcgagcggtatcagctcactcaaaggcgg
taatacggttatccacagaatcaggggataacgcaggaaagaacatgtgagcaaaaggccagcaaaaggccagga
accgtaaaaaggccgcgttgctggcgtttttccataggctccgcccccctgacgagcatcacaaaaatcgacgct
caagtcagaggtggcgaaacccgacaggactataaagataccaggcgtttccccctggaagctccctcgtgcgct
ctcctgttccgaccctgccgcttaccggatacctgtccgcctttctcccttcgggaagcgtggcgctttctcata
gctcacgctgtaggtatctcagttcggtgtaggtcgttcgctccaagctgggctgtgtgcacgaaccccccgttc
agcccgaccgctgcgccttatccggtaactatcgtcttgagtccaacccggtaagacacgacttatcgccactgg
cagcagccactggtaacaggattagcagagcgaggtatgtaggcggtgctacagagttcttgaagtggtggccta
actacggctacactagaagaacagtatttggtatctgcgctctgctgaagccagttaccttcggaaaaagagttg
gtagctcttgatccggcaaacaaaccaccgctggtagcggtggtttttttgtttgcaagcagcagattacgcgca
gaaaaaaaggatctcaagaagatcctttgatcttttctacggggtctgacgctcagtggaacgaaaactcacgtt
aagggattttggtcatgagattatcaaaaaggatcttcacctagatccttttaaattaaaaatgaagttttaaat
caatctaaagtatatatgagtaaacttggtctgacagttaccaatgcttaatcagtgaggcacctatctcagcga
tctgtctatttcgttcatccatagttgcctgactcggggggggggggcgctgaggtctgcctcgtgaagaaggtg
ttgctgactcataccaggcctgaatcgccccatcatccagccagaaagtgagggagccacggttgatgagagctt
tgttgtaggtggaccagttggtgattttgaacttttgctttgccacggaacggtctgcgttgtcgggaagatgcg
tgatctgatccttcaactcagcaaaagttcgatttattcaacaaagccgccgtcccgtcaagtcagcgtaatgct
ctgccagtgttacaaccaattaaccaattctgattagaaaaactcatcgagcatcaaatgaaactgcaatttatt
catatcaggattatcaataccatatttttgaaaaagccgtttctgtaatgaaggagaaaactcaccgaggcagtt
ccataggatggcaagatcctggtatcggtctgcgattccgactcgtccaacatcaatacaacctattaatttccc
ctcgtcaaaaataaggttatcaagtgagaaatcaccatgagtgacgactgaatccggtgagaatggcaaaagctt
atgcatttctttccagacttgttcaacaggccagccattacgctcgtcatcaaaatcactcgcatcaaccaaacc
gttattcattcgtgattgcgcctgagcgagacgaaatacgcgatcgctgttaaaaggacaattacaaacaggaat
cgaatgcaaccggcgcaggaacactgccagcgcatcaacaatattttcacctgaatcaggatattcttctaatac
ctggaatgctgttttcccggggatcgcagtggtgagtaaccatgcatcatcaggagtacggataaaatgcttgat
ggtcggaagaggcataaattccgtcagccagtttagtctgaccatctcatctgtaacatcattggcaacgctacc
tttgccatgtttcagaaacaactctggcgcatcgggcttcccatacaatcgatagattgtcgcacctgattgccc
gacattatcgcgagcccatttatacccatataaatcagcatccatgttggaatttaatcgcggcctcgagcaaga
cgtttcccgttgaatatggctcataacaccccttgtattactgtttatgtaagcagacagttttattgttcatga
tgatatattttttatcttgtgcaatgtaacatcagagattttgagacacaacgtggctttcccccccccccccatta
ttgaagcatttatcagggttattgtctcatgagcggatacatatttgaatgtatttagaaaaataaacaaatagg
ggttccgcgcacatttccccgaaaagtgccacctgacgtctaagaaaccattattatcatgacattaacctataa
aaataggcgtatcacgaggccctttcgtc

Figure 42D

AA sequence of capsid mfpypqlnfppvyptnpmayrdpnpprrrwrpfrpplaaqiedlrrsianltfkqrapnpppgpppnnnksapkp
kptqpkkkkqqakktkrkpkpgkrqrmcmklesdktfpimlngqvngyacvvggrlmkplhvegkidneqlaavk
lkkasmydleygdvpqnmksdtlqytsdkppgfynwhhgavqyengrftvprgvggkgdsgrpildnrgrvvaiv
lgganegtrtalsvvtwnqkgvtikdtpegsepwslvtalcvlsnvtfpcdkppvcyslapertldvleenvdnp
nydtllenvlkcpsrrpkrsitddftltspylgfcpycrhsapcfspikienvwdesddgsiriqvsaqfgynqa
gtadvtkfrymsydhdhdikedsmeklaistsgpcrrlghkgyfllaqcppgdsvtvsitsgasensctvekkir
rkfvgreeylfppvhgklvkchvydhlketsagyitmhrpgphayksyleeasgevyikppsgknvtyeckcgdy
stgivstrtkmngctkakqciaykrdqtkwvfnspdlirhtdhsvqgklhipfrltptvcpvplahtptvtkwfk
gitlhltatrptllttrklglradataewitgttsrnfsvgregleyvwgnhepvrvwaqesapgdphgwpheii
ihyyhrhpvytvivlcgvalailvgtassaaciakarrdcltpyalapnatvptalavlccirptnaetfgetln
hlwfnnqpflwaqlciplaaliilfrcfsccmpfllvagvclgkvdafehattvpnvpgipykalveragyapln
leitvvsseltpstnkeyvtckfhtvvpspqvkccgsleckasskadytcrvfggvypfmwggaqcfcdsentql
seayvefapdctidhavalkvhtaalkvglrivygnttarldtfvngvtpgssrdlkviagpisaafspfdhkvv
irkglvynydfpeygamnpgafgdiqassldatdivartdirllkpsvknihvpytqavsgyemwknnsgrplqe

Figure 42D continued tapfgckieveplratncayghipisidipdaafvrssesptilevsctvadciysadfggsltlqykanreghc
pvhshsttavlkeatthvtatgsitlhfstsspqanfivslcgkkttcnaeckppadhiigephkvdqefqaavs
ktswnwllalfggasslivvglivlvcssmlintrr

Figure 43A

CMV/R VEEV TC83 strain K64N VLP

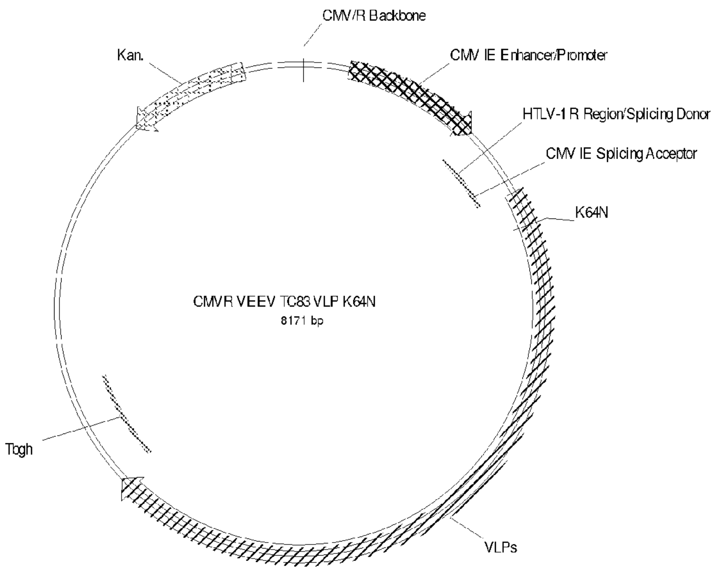

Figure 43B
Insert sequence atgttcccgttccagccaatgtatccgatgcagccaatgccctatcgcaacccgttcgcggccccgcgcaggccc
tggttccccagaaccgacccttttctggcgatgcaggtgcaggaattaacccgctcgatggctaacctgacgttc
aagcaacgccgggacgcgccacctgaggggccatccgctaataaaccgaagaaggaggcctcgcaaaaacagaaa
gggggaggccaagggaagaagaagaagaaccaagggaagaagaaggctaagacagggccgcctaatccgaaggca
cagaatggaaacaagaagaagaccaacaagaaaccaggcaagagacagcgcatggtcatgaaattggaatctgac
aagacgttcccaatcatgttggaagggaagataaacggctacgcttgtgtggtcggagggaagttattcaggccg
atgcatgtggaaggcaagatcgacaacgacgttctggccgcgcttaagacgaagaaagcatccaaatacgatctt
gagtatgcagatgtgccacagaacatgcgggccgatacattcaaatacacccatgagaaaccccaaggctattac
agctggcatcatggagcagtccaatatgaaaatgggcgtttcacggtgccgaaaggagttggggccaagggagac
agcggacgacccattctggataaccagggacgggtggtcgctattgtgctgggaggtgtgaatgaaggatctagg
acagccctttcagtcgtcatgtggaacgagaagggagttaccgtgaagtatactccggagaactgcgagcaatgg
tcactagtgaccaccatgtgtctgctcgccaatgtgacgttcccatgtgctcaaccaccaatttgctacgacaga
aaaccagcagagactttggccatgctcagcgttaacgttgacaacccgggctacgatgagctgctggaagcagct
gttaagtgccccggaaggaaaaggagatccaccgaggagctgtttaatgagtataagctaacgcgcccttacatg
gccagatgcatcagatgtgcagttgggagctgccatagtccaatagcaatcgaggcagtaaagagcgacgggcac
gacggttatgttagacttcagacttcctcgcagtatggcctggattcctccggcaacttaaagggcaggaccatg
cggtatgacatgcacgggaccattaaagagataccactacatcaagtgtcactctatacatctcgcccgtgtcac
attgtggatgggcacggttatttcctgcttgccaggtgcccggcaggggactccatcaccatggaatttaagaaa
gattccgtcagacactcctgctcggtgccgtatgaagtgaaatttaatcctgtaggcagagaactctatactcat
cccccagaacacggagtagagcaagcgtgccaagtctacgcacatgatgcacagaacagaggagcttatgtcgag
atgcacctcccgggctcagaagtggacagcagtttggtttccttgagcggcagttcagtcaccgtgacacctcct
gatgggactagcgccctggtggaatgcgagtgtggcggcacaaagatctccgagaccatcaacaagacaaaacag
ttcagccagtgcacaaagaaggagcagtgcagagcatatcggctgcagaacgataagtgggtgtataattctgac
aaactgcccaaagcagcgggagccaccttaaaaggaaaactgcatgtcccattcttgctggcagacggcaaatgc
accgtgcctctagcaccagaacctatgataaccttcggtttcagatcagtgtcactgaaactgcaccctaagaat
cccacatatctaatcacccgccaacttgctgatgagcctcactacacgcacgagctcatatctgaaccagctgtt
aggaattttaccgtcaccgaaaaagggtgggagtttgtatggggaaaccacccgccgaaaaggttttgggcacag
gaaacagcacccggaaatccacatgggctaccgcacgaggtgataactcattattaccacagataccctatgtcc
accatcctgggtttgtcaatttgtgccgccattgcaaccgtttccgttgcagcgtctacctggctgttttgcaga
tctagagttgcgtgcctaactccttaccggctaacacctaacgctaggataccattttgtctggctgtgctttgc

Figure 43B continued tgcgcccgcactgcccgggccgagaccacctgggagtccttggatcacctatggaacaataaccaacagatgttc
tggattcaattgctgatccctctggccgccttgatcgtagtgactcgcctgctcaggtgcgtgtgctgtgtcgtg
cctttttagtcatggccggcgccgcaggcgccggcgcctacgagcacgcgaccacgatgccgagccaagcggga
atctcgtataacactatagtcaacagagcaggctacgcaccactccctatcagcataacaccaacaaagatcaag
ctgatacctacagtgaacttggagtacgtcacctgccactacaaaacaggaatggattcaccagccatcaaatgc
tgcggatctcaggaatgcactccaacttacaggcctgatgaacagtgcaaagtcttcacaggggtttacccgttc
atgtggggtggtgcatattgcttttgcgacactgagaacacccaagtcagcaaggcctacgtaatgaaatctgac
gactgccttgcggatcatgctgaagcatataaagcgcacacagcctcagtgcaggcgttcctcaacatcacagtg
ggagaacactctattgtgactaccgtgtatgtgaatggagaaactcctgtgaatttcaatggggtcaaaataact
gcaggtccgctttccacagcttggacaccctttgatcgcaaaatcgtgcagtatgccggggagatctataattat
gattttcctgagtatggggcaggacaaccaggagcatttggagatatacaatccagaacagtctcaagctctgat
ctgtatgccaataccaacctagtgctgcagagacccaaagcaggagcgatccacgtgccatacactcaggcacct
tcgggttttgagcaatggaagaaagataaagctccatcattgaaatttaccgcccctttcggatgcgaaatatat
acaaaccccattcgcgccgaaaactgtgctgtagggtcaattccattagcctttgacattcccgacgccttgttc
accagggtgtcagaaacaccgacactttcagcggccgaatgcactcttaacgagtgcgtgtattcttccgacttt
ggtgggatcgccacggtcaagtactcggccagcaagtcaggcaagtgcgcagtccatgtgccatcagggactgct
accctaaaagaagcagcagtcgagctaaccgagcaagggtcggcgactatccatttctcgaccgcaaatatccac
ccggagttcaggctccaaatatgcacatcatatgttacgtgcaaaggtgattgtcacccccgaaagaccatatt
gtgacacaccctcagtatcacgcccaaacatttacagccgcggtgtcaaaaaccgcgtggacgtggttaacatcc
ctgctgggaggatcagccgtaattattataattggcttggtgctggctactattgtggccatgtacgtgctgacc
aaccagaaacataattaag Figure 43C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccgttccagccaatgtatccgatgcagccaatgccctatcgc
aacccgttcgcggcccccgcgcaggccctggttccccagaaccgaccctttctggcgatgcaggtgcaggaatta
acccgctcgatggctaacctgacgttcaagcaacgccgggacgcgccacctgagggcccatccgctaataaaccg
aagaaggaggcctcgcaaaaacagaaagggggaggccaagggaagaagaagaagaaccaagggaagaagaaggct
aagacagggccgcctaatccgaaggcacagaatggaaacaagaagaagaccaacaagaaaccaggcaagagacag
cgcatggtcatgaaattggaatctgacaagacgttcccaatcatgttggaagggaagataaacggctacgcttgt
gtggtcggagggaagttattcaggccgatgcatgtggaaggcaagatcgacaacgacgttctggccgcgcttaag
acgaagaaagcatccaaatacgatcttgagtatgcagatgtgccacagaacatgcgggccgatacattcaaatac
acccatgagaaaccccaaggctattacagctggcatcatggagcagtccaatatgaaaatgggcgtttcacggtg
ccgaaaggagttggggccaagggagacagcggacgacccattctggataaccagggacggtggtcgctattgtg
ctgggaggtgtgaatgaaggatctaggacagccctttcagtcgtcatgtggaacgagaacggagttaccgtgaag
tatactccggagaactgcgagcaatggtcactagtgaccaccatgtgtctgctcgccaatgtgacgttcccatgt
gctcaaccaccaatttgctacgacagaaaaccagcagagactttggccatgctcagcgttaacgttgacaacccg
ggctacgatgagctgctggaagcagctgttaagtgccccggaaggaaaaggagatccaccgaggagctgtttaat
gagtataagctaacgcgcccttacatggccagatgcatcagatgtgcagttgggagctgccatagtccaatagca
atcgaggcagtaaagagcgacgggcacgacggttatgttagacttcagacttcctcgcagtatggcctggattcc
tccggcaacttaaagggcaggaccatgcggtatgacatgcacgggaccattaaagagataccactacatcaagtg

Figure 43C continued tcactctatacatctcgcccgtgtcacattgtggatgggcacggttatttcctgcttgccaggtgcccggcaggg
gactccatcaccatggaatttaagaaagattccgtcagacactcctgctcggtgccgtatgaagtgaaatttaat
cctgtaggcagagaactctatactcatcccccagaacacggagtagagcaagcgtgccaagtctacgcacatgat
gcacagaacagaggagcttatgtcgagatgcacctcccgggctcagaagtggacagcagtttggtttccttgagc
ggcagttcagtcaccgtgacacctcctgatgggactagcgccctggtggaatgcgagtgtggcggcacaaagatc
tccgagaccatcaacaagacaaaacagttcagccagtgcacaaagaaggagcagtgcagagcatatcggctgcag
aacgataagtgggtgtataattctgacaaactgcccaaagcagcgggagccaccttaaaggaaaactgcatgtc
ccattcttgctggcagacggcaaatgcaccgtgcctctagcaccagaacctatgataaccttcggtttcagatca
gtgtcactgaaactgcaccctaagaatcccacatatctaatcacccgccaacttgctgatgagcctcactacacg
cacgagctcatatctgaaccagctgttaggaattttaccgtcaccgaaaaagggtgggagtttgtatgggaaac
cacccgccgaaaaggttttgggcacaggaaacagcacccggaaatccacatgggctaccgcacgaggtgataact
cattattaccacagataccctatgtccaccatcctgggtttgtcaatttgtgccgccattgcaaccgtttccgtt
gcagcgtctacctggctgttttgcagatctagagttgcgtgcctaactccttaccggctaacacctaacgctagg
ataccattttgtctggctgtgctttgctgcgcccgcactgcccgggccgagaccacctgggagtccttggatcac
ctatggaacaataaccaacagatgttctggattcaattgctgatccctctggccgccttgatcgtagtgactcgc
ctgctcaggtgcgtgtgctgtgtcgtgcctttttttagtcatggccggcgccgcaggcgccggcgcctacgagcac
gcgaccacgatgccgagccaagcgggaatctcgtataacactatagtcaacagagcaggctacgcaccactccct
atcagcataacaccaacaaagatcaagctgatacctacagtgaacttggagtacgtcacctgccactacaaaaca
ggaatggattcaccagccatcaaatgctgcggatctcaggaatgcactccaacttacaggcctgatgaacagtgc
aaagtcttcacaggggtttacccgttcatgtggggtggtgcatattgcttttgcgacactgagaacacccaagtc
agcaaggcctacgtaatgaaatctgacgactgccttgcggatcatgctgaagcatataaagcgcacacagcctca
gtgcaggcgttcctcaacatcacagtgggagaacactctattgtgactaccgtgtatgtgaatggagaaactcct
gtgaatttcaatggggtcaaaataactgcaggtccgctttccacagcttggacaccctttgatcgcaaaatcgtg
cagtatgccgggcagatctataattatgattttcctgagtatggggcaggacaaccaggagcatttggagatata
caatccagaacagtctcaagctctgatctgtatgccaataccaacctagtgctgcagagacccaaagcaggagcg
atccacgtgccatacactcaggcaccttcgggttttgagcaatggaagaaagataaagctccatcattgaaattt
accgcccctttcggatgcgaaatatatacaaaccccattcgcgccgaaaactgtgctgtagggtcaattccatta
gcctttgacattcccgacgccttgttcaccagggtgtcagaaacaccgacactttcagcggccgaatgcactctt
aacgagtgcgtgtattcttccgactttggtgggatcgccacggtcaagtactcggccagcaagtcaggcaagtgc
gcagtccatgtgccatcagggactgctaccctaaaagaagcagcagtcgagctaaccgagcaagggtcggcgact
atccatttctcgaccgcaaatatccacccggagttcaggctccaaatatgcacatcatatgttacgtgcaaaggt
gattgtcacccccccgaaagaccatattgtgacacaccctcagtatcacgcccaaacatttacagccgcggtgtca
aaaaccgcgtggacgtggttaacatccctgctgggaggatcagccgtaattattataattggcttggtgctggct
actattgtggccatgtacgtgctgaccaaccagaaacataattaaggatccagatctgctgtgccttctagttgc
cagccatctgttgtttgcccctcccccgtgccttccttgaccctggaaggtgccactcccactgtcctttcctaa
taaaatgaggaaattgcatcgcattgtctgagtaggtgtcattctattctggggggtggggtggggcaggacagc
aagggggaggattgggaagacaatagcaggcatgctggggatgcggtgggctctatgggtacccaggtgctgaag
aattgacccggttcctcctgggccagaaagaagcaggcacatccccttctctgtgacacaccctgtccacgcccc
tggttcttagttccagccccactcataggacactcatagctcaggagggctccgccttcaatcccacccgctaaa
gtacttggagcggtctctccctccctcatcagcccaccaaaccaaacctagcctccaagagtgggaagaaattaa
agcaagataggctattaagtgcagagggagagaaaatgcctccaacatgtgaggaagtaatgagagaaatcatag
aattttaaggccatgatttaaggccatcatggccttaatcttccgcttcctcgctcactgactcgctgcgctcgg
tcgttcggctgcggcgagcggtatcagctcactcaaaggcggtaatacggttatccacagaatcaggggataacg
caggaaagaacatgtgagcaaaaggccagcaaaaggccaggaaccgtaaaaaggccgcgttgctggcgtttttcc
ataggctccgcccccctgacgagcatcacaaaaatcgacgctcaagtcagaggtggcgaaacccgacaggactat
aaagataccaggcgtttccccctggaagctccctcgtgcgctctcctgttccgaccctgccgcttaccggatacc
tgtccgcctttctcccttcgggaagcgtggcgctttctcatagctcacgctgtaggtatctcagttcggtgtagg
tcgttcgctccaagctgggctgtgtgcacgaaccccccgttcagcccgaccgctgcgccttatccggtaactatc
gtcttgagtccaacccggtaagacacgacttatcgccactggcagcagccactggtaacaggattagcagagcga
ggtatgtaggcggtgctacagagttcttgaagtggtggcctaactacggctacactagaagaacagtatttggta
tctgcgctctgctgaagccagttaccttcggaaaaagagttggtagctcttgatccggcaaacaaaccaccgctg
gtagcggtggtttttttgtttgcaagcagcagattacgcgcagaaaaaaaggatctcaagaagatcctttgatct
tttctacggggtctgacgctcagtggaacgaaaactcacgttaagggattttggtcatgagattatcaaaaagga
tcttcacctagatccttttaaattaaaaatgaagttttaaatcaatctaaagtatatatgagtaaacttggtctg
acagttaccaatgcttaatcagtgaggcacctatctcagcgatctgtctatttcgttcatccatagttgcctgac
tcggggggggggggcgctgaggtctgcctcgtgaagaaggtgttgctgactcataccaggcctgaatcgccccat
catccagccagaaagtgagggagccacggttgatgagagctttgttgtaggtggaccagttggtgattttgaact
tttgctttgccacggaacggtctgcgttgtcgggaagatgcgtgatctgatccttcaactcagcaaaagttcgat
ttattcaacaaagccgccgtcccgtcaagtcagcgtaatgctctgccagtgttacaaccaattaaccaattctga
ttagaaaaactcatcgagcatcaaatgaaactgcaatttattcatatcaggattatcaataccatatttttgaaa
aagccgtttctgtaatgaaggagaaaactcaccgaggcagttccataggatggcaagatcctggtatcggtctgc

Figure 43C continued gattccgactcgtccaacatcaatacaacctattaatttcccctcgtcaaaaataaggttatcaagtgagaaatc
accatgagtgacgactgaatccggtgagaatggcaaaagcttatgcatttctttccagacttgttcaacaggcca
gccattacgctcgtcatcaaaatcactcgcatcaaccaaaccgttattcattcgtgattgcgcctgagcgagacg
aaatacgcgatcgctgttaaaaggacaattacaaacaggaatcgaatgcaaccggcgcaggaacactgccagcgc
atcaacaatattttcacctgaatcaggatattcttctaatacctggaatgctgttttcccggggatcgcagtggt
gagtaaccatgcatcatcaggagtacggataaaatgcttgatggtcggaagaggcataaattccgtcagccagtt
tagtctgaccatctcatctgtaacatcattggcaacgctacctttgccatgtttcagaaacaactctggcgcatc
gggcttcccatacaatcgatagattgtcgcacctgattgcccgacattatcgcgagcccatttatacccatataa
atcagcatccatgttggaatttaatcgcggcctcgagcaagacgtttcccgttgaatatggctcataacacccct
tgtattactgtttatgtaagcagacagttttattgttcatgatgatatatttttatcttgtgcaatgtaacatca
gagattttgagacacaacgtggctttcccccccccccccattattgaagcatttatcagggttattgtctcatgag
cggatacatatttgaatgtatttagaaaaataaacaaataggggttccgcgcacatttccccgaaaagtgccacc
tgacgtctaagaaaccattattatcatgacattaacctataaaaataggcgtatcacgaggccctttcgtc Figure 43D
Capsid AA sequence mfpfqpmypmqpmpyrnpfaaprrpwfprtdpflamqvqeltrsmanltfkqrrdappegpsankpkkeasqkqk
gggqgkkkknqgkkkaktgppnpkaqngnkkktnkkpgkrqrmvmklesdktfpimlegkingyacvvggklfrp
mhvegkidndvlaalktkkaskydleyadvpqnmradtfkythekpqgyyswhhgavqyengrftvpkgvgakgd
sgrpildnqgrvvaivlggvnegsrtalsvvmwnekgvtvkytpenceqwslvttmcllanvtfpcaqppicydr
kpaetlamlsvnvdnpgydelleaavkcpgrkrrsteelfneykltrpymarcircavgschspiaieavksdgh
dgyvrlqtssqygldssgnlkgrtmrydmhgtikeiplhqvslytsrpchivdghgyfllarcpagdsitmefkk
dsvrhscsvpyevkfnpvgrelythppehgveqacqvyahdaqnrgayvemhlpgsevdsslvslsgssvtvtpp
dgtsalvececggtkisetinktkqfsqctkkeqcrayrlqndkwvynsdklpkaagatlkgklhvpflladgkc
tvplapepmitfgfrsvslklhpknptylitrqladephythelisepavrnftvtekgwefvwgnhppkrfwaq
etapgnphglphevithyyhrypmstilglsicaaiatvsvaastwlfcrsrvacltpyrltpnaripfclavlc
cartaraettwesldhlwnnnqqmfwiqlliplaalivvtrllrcvccvvpflvmagaagagayehattmpsqag
isyntivnragyaplpisitptkikliptvnleyvtchyktgmdspaikccgsqectptyrpdeqckvftgvypf
mwggaycfcdtentqvskayvmksddcladhaeaykahtasvqaflnitvgehsivttvyvngetpvnfngvkit
agplstawtpfdrkivqyageiynydfpeygagqpgafgdiqsrtvsssdlyantnlvlqrpkagaihvpytqap
sgfeqwkkdkapslkftapfgceiytnpiraencavgsiplafdipdalftrvsetptlsaaectlnecvyssdf
ggiatvkysasksgkcavhvpsgtatlkeaavelteqgsatihfstanihpefrlqictsyvtckgdchppkdhi
vthpqyhaqtftaavsktawtwltsllggsaviiiiglvlativamyvltnqkhn*

Figure 44A

CMV/R VEEV TC83 strain K64N K65N VLP

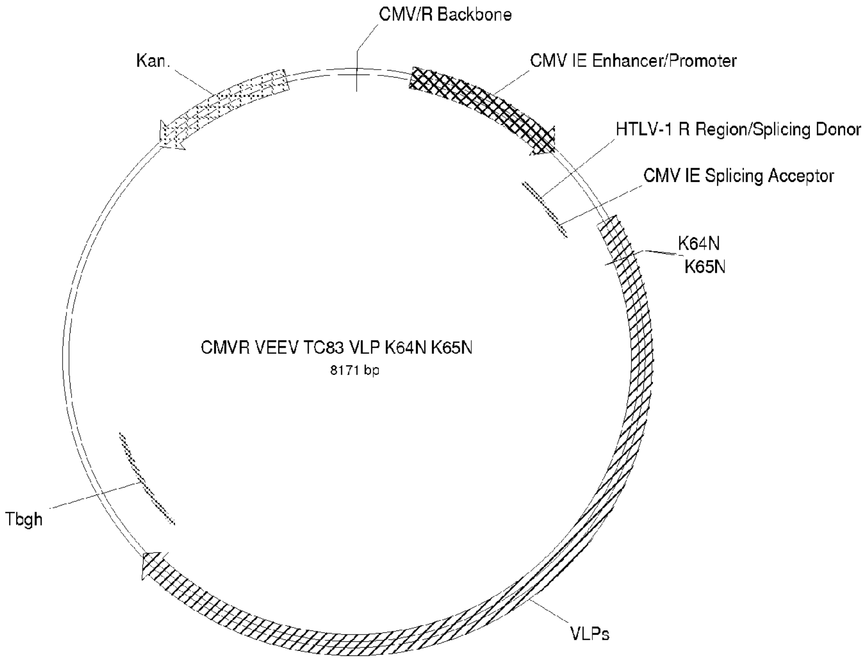

Figure 44B
Insert sequence atgttcccgttccagccaatgtatccgatgcagccaatgccctatcgcaacccgttcgcggccccgcgcaggccc
tggttccccagaaccgaccctttctggcgatgcaggtgcaggaattaacccgctcgatggctaacctgacgttc
aagcaacgccgggacgcgccacctgaggggccatccgctaataatccgaagaaggaggcctcgcaaaaacagaaa
gggggaggccaagggaagaagaagaagaaccaagggaagaagaaggctaagacagggccgcctaatccgaaggca
cagaatggaaacaagaagaagaccaacaagaaaccaggcaagagacagcgcatggtcatgaaattggaatctgac
aagacgttcccaatcatgttggaagggaagataaacggctacgcttgtgtggtcggagggaagttattcaggccg
atgcatgtggaaggcaagatcgacaacgacgttctggccgcgcttaagacgaagaaagcatccaaatacgatctt
gagtatgcagatgtgccacagaacatgcgggccgatacattcaaatacacccatgagaaaccccaaggctattac
agctggcatcatggagcagtccaatatgaaaatgggcgtttcacggtgccgaaaggagttggggccaagggagac
agcggacgacccattctggataaccagggacgggtggtcgctattgtgctgggaggtgtgaatgaaggatctagg
acagccctttcagtcgtcatgtggaacgagaagggagttaccgtgaagtatactccggagaactgcgagcaatgg
tcactagtgaccaccatgtgtctgctcgccaatgtgacgttcccatgtgctcaaccaccaatttgctacgacaga
aaaccagcagagactttggccatgctcagcgttaacgttgacaacccgggctacgatgagctgctggaagcagct
gttaagtgccccggaaggaaaaggagatccaccgaggagctgtttaatgagtataagctaacgcgcccttacatg
gccagatgcatcagatgtgcagttgggagctgccatagtccaatagcaatcgaggcagtaaagagcgacgggcac
gacggttatgttagacttcagacttcctcgcagtatggcctggattcctccggcaacttaaagggcaggaccatg
cggtatgacatgcacgggaccattaaagagataccactacatcaagtgtcactctatacatctcgcccgtgtcac
attgtggatgggcacggttatttcctgcttgccaggtgcccggcaggggactccatcaccatggaatttaagaaa
gattccgtcagacactcctgctcggtgccgtatgaagtgaaatttaatcctgtaggcagagaactctatactcat
cccccagaacacggagtagagcaagcgtgccaagtctacgcacatgatgcacagaacagaggagcttatgtcgag
atgcacctcccgggctcagaagtggacagcagtttggtttccttgagcggcagttcagtcaccgtgacacctcct
gatgggactagcgccctggtggaatgcgagtgtggcggcacaaagatctccgagaccatcaacaagacaaaacag
ttcagccagtgcacaaagaaggagcagtgcagagcatatcggctgcagaacgataagtgggtgtataattctgac
aaactgcccaaagcagcgggagccaccttaaaaggaaaactgcatgtcccattcttgctggcagacggcaaatgc
accgtgcctctagcaccagaacctatgataaccttcggtttcagatcagtgtcactgaaactgcaccctaagaat
cccacatatctaatcacccgccaacttgctgatgagcctcactacacgcacgagctcatatctgaaccagctgtt

Figure 44B continued aggaattttaccgtcaccgaaaaagggtgggagtttgtatggggaaaccacccgccgaaaggttttgggcacag
gaaacagcacccggaaatccacatgggctaccgcacgaggtgataactcattattaccacagataccctatgtcc
accatcctgggtttgtcaatttgtgccgccattgcaaccgtttccgttgcagcgtctacctggctgttttgcaga
tctagagttgcgtgcctaactccttaccggctaacacctaacgctaggataccattttgtctggctgtgctttgc
tgcgcccgcactgcccgggccgagaccacctgggagtccttggatcacctatggaacaataaccaacagatgttc
tggattcaattgctgatccctctggccgccttgatcgtagtgactcgcctgctcaggtgcgtgtgctgtgtcgtg
ccttttttagtcatggccggcgccgcaggcgccggcgcctacgagcacgcgaccacgatgccgagccaagcggga
atctcgtataacactatagtcaacagagcaggctacgcaccactccctatcagcataacaccaacaaagatcaag
ctgatacctacagtgaacttggagtacgtcacctgccactacaaaacaggaatggattcaccagccatcaaatgc
tgcggatctcaggaatgcactccaacttacaggcctgatgaacagtgcaaagtcttcacaggggtttacccgttc
atgtggggtggtgcatattgcttttgcgacactgagaacacccaagtcagcaaggcctacgtaatgaaatctgac
gactgccttgcggatcatgctgaagcatataaagcgcacacagcctcagtgcaggcgttcctcaacatcacagtg
ggagaacactctattgtgactaccgtgtatgtgaatggagaaactcctgtgaatttcaatggggtcaaaataact
gcaggtccgctttccacagcttggacaccctttgatcgcaaaatcgtgcagtatgccggggagatctataattat
gattttcctgagtatggggcaggacaaccaggagcatttggagatatacaatccagaacagtctcaagctctgat
ctgtatgccaataccaacctagtgctgcagagacccaaagcaggagcgatccacgtgccatacactcaggcacct
tcgggttttgagcaatggaagaaagataaagctccatcattgaaatttaccgcccctttcggatgcgaaatatat
acaaaccccattcgcgccgaaaactgtgctgtagggtcaattccattagcctttgacattcccgacgccttgttc
accagggtgtcagaaacaccgacactttcagcggccgaatgcactcttaacgagtgcgtgtattcttccgacttt
ggtgggatcgccacggtcaagtactcggccagcaagtcaggcaagtgcgcagtccatgtgccatcagggactgct
accctaaaagaagcagcagtcgagctaaccgagcaagggtcggcgactatccatttctcgaccgcaaatatccac
ccggagttcaggctccaaatatgcacatcatatgttacgtgcaaaggtgattgtcacccccgaaagaccatatt
gtgacacaccctcagtatcacgcccaaacatttacagccgcggtgtcaaaaaccgcgtggacgtggttaacatcc
ctgctgggaggatcagccgtaattattataattggcttggtgctggctactattgtggccatgtacgtgctgacc
aaccagaaacataattaag Figure 44C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccgttccagccaatgtatccgatgcagccaatgccctatcgc
aacccgttcgcggccccgcgcaggccctggttccccagaaccgacccttttctggcgatgcaggtgcaggaatta
acccgctcgatggctaacctgacgttcaagcaacgccgggacgcgccacctgaggggccatccgctaataatccg
aagaaggaggcctcgcaaaaacagaaaggggga ggccaaggga agaagaagaaccaagggaagaagaaggct
aagacagggccgcctaatccgaaggcacagaatggaaacaagaagaagaccaacaagaaaccaggcaagagacag
cgcatggtcatgaaattggaatctgacaagacgttcccaatcatgttggaagggaagataaacggctacgcttgt
gtggtcggagggaagttattcaggccgatgcatgtggaaggcaagatcgacaacgacgttctggccgcgcttaag
acgaagaaagcatccaaatacgatcttgagtatgcagatgtgccacagaacatgcgggccgatacattcaaatac
acccatgagaaaccccaaggctattacagctggcatcatggagcagtccaatatgaaaatgggcgtttcacggtg
ccgaaaggagttggggccaagggagacagcggacgacccattctggataaccagggacgggtggtcgctattgtg
ctgggaggtgtgaatgaaggatctaggacagccctttcagtcgtcatgtggaacgagaagggagttaccgtgaag
tatactccggagaactgcgagcaatggtcactagtgaccaccatgtgtctgctcgccaatgtgacgttcccatgt
gctcaaccaccaatttgctacgacagaaaaccagcagagactttggccatgctcagcgttaacgttgacaacccg
ggctacgatgagctgctggaagcagctgttaagtgccccggaaggaaaaggagatccaccgaggagctgtttaat

Figure 44C continued gagtataagctaacgcgcccttacatggccagatgcatcagatgtgcagttgggagctgccatagtccaatagca
atcgaggcagtaaagagcgacgggcacgacggttatgttagacttcagacttcctcgcagtatggcctggattcc
tccggcaacttaaagggcaggaccatgcggtatgacatgcacgggaccattaaagagataccactacatcaagtg
tcactctatacatctcgcccgtgtcacattgtggatgggcacggttatttcctgcttgccaggtgcccggcaggg
gactccatcaccatggaatttaagaaagattccgtcagacactcctgctcggtgccgtatgaagtgaaatttaat
cctgtaggcagagaactctatactcatcccccagaacacggagtagagcaagcgtgccaagtctacgcacatgat
gcacagaacagaggagcttatgtcgagatgcacctcccgggctcagaagtggacagcagtttggtttccttgagc
ggcagttcagtcaccgtgacacctcctgatgggactagcgccctggtggaatgcgagtgtggcggcacaaagatc
tccgagaccatcaacaagacaaaacagttcagccagtgcacaaagaaggagcagtgcagagcatatcggctgcag
aacgataagtgggtgtataattctgacaaactgcccaaagcagcgggagccaccttaaaggaaaactgcatgtc
ccattcttgctggcagacggcaaatgcaccgtgcctctagcaccagaacctatgataaccttcggtttcagatca
gtgtcactgaaactgcaccctaagaatcccacatatctaatcacccgccaacttgctgatgagcctcactacacg
cacgagctcatatctgaaccagctgttaggaattttaccgtcaccgaaaagggtgggagtttgtatggggaaac
cacccgccgaaaaggttttgggcacaggaaacagcacccggaaatccacatgggctaccgcacgaggtgataact
cattattaccacagataccctatgtccaccatcctgggtttgtcaatttgtgccgccattgcaaccgtttccgtt
gcagcgtctacctggctgttttgcagatctagagttgcgtgcctaactccttaccggctaacacctaacgctagg
ataccattttgtctggctgtgctttgctgcgcccgcactgcccgggccgagaccacctgggagtccttggatcac
ctatggaacaataaccaacagatgttctggattcaattgctgatccctctggccgccttgatcgtagtgactcgc
ctgctcaggtgcgtgtgctgtgtcgtgcctttttttagtcatggccggcgccgcaggcgccggcgcctacgagcac
gcgaccacgatgccgagccaagcgggaatctcgtataacactatagtcaacagagcaggctacgcaccactccct
atcagcataacaccaacaaagatcaagctgatacctacagtgaacttggagtacgtcacctgccactacaaaaca
ggaatggattcaccagccatcaaatgctgcggatctcaggaatgcactccaacttacaggcctgatgaacagtgc
aaagtcttcacaggggtttacccgttcatgtggggtggtgcatattgcttttgcgacactgagaacacccaagtc
agcaaggcctacgtaatgaaatctgacgactgccttgcggatcatgctgaagcatataaagcgcacacagcctca
gtgcaggcgttcctcaacatcacagtgggagaacactctattgtgactaccgtgtatgtgaatggagaaactcct
gtgaatttcaatggggtcaaaataactgcaggtccgctttccacagcttggacaccctttgatcgcaaaatcgtg
cagtatgccggggagatctataattatgattttcctgagtatggggcaggacaaccaggagcatttggagatata
caatccagaacagtctcaagctctgatctgtatgccaataccaacctagtgctgcagagacccaaagcaggagcg
atccacgtgccatacactcaggcaccttcgggttttgagcaatggaagaaagataaagctccatcattgaaattt
accgcccctttcggatgcgaaatatatacaaaccccattcgcgccgaaaactgtgctgtagggtcaattccatta
gcctttgacattcccgacgccttgttcaccagggtgtcagaaacaccgacactttcagcggccgaatgcactctt
aacgagtgcgtgtattcttccgactttggtgggatcgccacggtcaagtactcggccagcaagtcaggcaagtgc
gcagtccatgtgccatcagggactgctaccctaaaagaagcagcagtcgagctaaccgagcaagggtcggcgact
atccatttctcgaccgcaaatatccacccggagttcaggctccaaatatgcacatcatatgttacgtgcaaaggt
gattgtcacccccccgaaagaccatattgtgacacaccctcagtatcacgcccaaacatttacagccgcggtgtca
aaaaccgcgtggacgtggttaacatccctgctgggaggatcagccgtaattattataattggcttggtgctggct
actattgtggccatgtacgtgctgaccaaccagaaacataattaaggatccagatctgctgtgccttctagttgc
cagccatctgttgtttgcccctcccccgtgccttccttgaccctggaaggtgccactcccactgtcctttcctaa
taaaatgaggaaattgcatcgcattgtctgagtaggtgtcattctattctggggggtggggtggggcaggacagc
aagggggaggattgggaagacaatagcaggcatgctggggatgcggtgggctctatgggtacccaggtgctgaag
aattgacccggttcctcctgggccagaaagaagcaggcacatccccttctctgtgacacaccctgtccacgcccc
tggttcttagttccagccccactcataggacactcatagctcaggagggctccgccttcaatcccacccgctaaa
gtacttggagcggtctctccctccctcatcagcccaccaaaccaaacctagcctccaagagtgggaagaaattaa
agcaagataggctattaagtgcagagggagagaaaatgcctccaacatgtgaggaagtaatgagagaaatcatag
aattttaaggccatgatttaaggccatcatggccttaatcttccgcttcctcgctcactgactcgctgcgctcgg
tcgttcggctgcggcgagcggtatcagctcactcaaaggcggtaatacggttatccacagaatcaggggataacg
caggaaagaacatgtgagcaaaaggccagcaaaaggccaggaaccgtaaaaaggccgcgttgctggcgtttttcc
ataggctccgcccccctgacgagcatcacaaaaatcgacgctcaagtcagaggtggcgaaacccgacaggactat
aaagataccaggcgtttccccctggaagctccctcgtgcgctctcctgttccgaccctgccgcttaccggatacc
tgtccgcctttctcccttcgggaagcgtggcgctttctcatagctcacgctgtaggtatctcagttcggtgtagg
tcgttcgctccaagctgggctgtgtgcacgaaccccccgttcagcccgaccgctgcgccttatccggtaactatc
gtcttgagtccaacccggtaagacacgacttatcgccactggcagcagccactggtaacaggattagcagagcga
ggtatgtaggcggtgctacagagttcttgaagtggtggcctaactacggctacactagaagaacagtatttggta
tctgcgctctgctgaagccagttaccttcggaaaaagagttggtagctcttgatccggcaaacaaaccaccgctg
gtagcggtggtttttttgtttgcaagcagcagattacgcgcagaaaaaaaggatctcaagaagatcctttgatct
tttctacggggtctgacgctcagtggaacgaaaactcacgttaagggattttggtcatgagattatcaaaaagga
tcttcacctagatccttttaaattaaaaatgaagttttaaatcaatctaaagtatatatgagtaaacttggtctg
acagttaccaatgcttaatcagtgaggcacctatctcagcgatctgtctatttcgttcatccatagttgcctgac
tcggggggggggggcgctgaggtctgcctcgtgaagaaggtgttgctgactcataccaggcctgaatcgccccat
catccagccagaaagtgagggagccacggttgatgagagctttgttgtaggtggaccagttggtgattttgaact
tttgctttgccacggaacggtctgcgttgtcgggaagatgcgtgatctgatccttcaactcagcaaaagttcgat

Figure 44C continued ttattcaacaaagccgccgtcccgtcaagtcagcgtaatgctctgccagtgttacaaccaattaaccaattctga
ttagaaaaactcatcgagcatcaaatgaaactgcaatttattcatatcaggattatcaataccatatttttgaaa
aagccgtttctgtaatgaaggagaaaactcaccgaggcagttccataggatggcaagatcctggtatcggtctgc
gattccgactcgtccaacatcaatacaacctattaatttcccctcgtcaaaaataaggttatcaagtgagaaatc
accatgagtgacgactgaatccggtgagaatggcaaaagcttatgcatttctttccagacttgttcaacaggcca
gccattacgctcgtcatcaaaatcactcgcatcaaccaaaccgttattcattcgtgattgcgcctgagcgagacg
aaatacgcgatcgctgttaaaaggacaattacaaacaggaatcgaatgcaaccggcgcaggaacactgccagcgc
atcaacaatattttcacctgaatcaggatattcttctaatacctggaatgctgttttcccggggatcgcagtggt
gagtaaccatgcatcatcaggagtacggataaaatgcttgatggtcggaagaggcataaattccgtcagccagtt
tagtctgaccatctcatctgtaacatcattggcaacgctacctttgccatgtttcagaaacaactctggcgcatc
gggcttcccatacaatcgatagattgtcgcacctgattgcccgacattatcgcgagcccatttatacccatataa
atcagcatccatgttggaatttaatcgcggcctcgagcaagacgtttcccgttgaatatggctcataacacccct
tgtattactgtttatgtaagcagacagttttattgttcatgatgatatatttttatcttgtgcaatgtaacatca
gagattttgagacacaacgtggctttccccccccccccattattgaagcatttatcagggttattgtctcatgag
cggatacatatttgaatgtatttagaaaaataaacaaataggggttccgcgcacatttccccgaaaagtgccacc
tgacgtctaagaaaccattattatcatgacattaacctataaaaataggcgtatcacgaggccctttcgtc Figure 44D
Capsid AA sequence mfpfqpmypmqpmpyrnpfaaprrpwfprtdpflamqvqeltrsmanltfkqrrdappegpsannpkkeasqkqk
gggqgkkkknqgkkkaktgppnpkaqnqnkkktnkkpgkrqrmvmklesdktfpimlegkingyacvvggklfrp
mhvegkidndvlaalktkkaskydleyadvpqnmradtfkythekpqgyyswhhgavqyengrftvpkgvgakgd
sgrpildnqgrvvaivlggvnegsrtalsvvmwnekgvtvkytpenceqwslvttmcllanvtfpcaqppicydr
kpaetlamlsvnvdnpgydelleaavkcpgrkrrsteelfneykltrpymarcircavgschspiaieavksdgh
dgyvrlqtssqygldssgnlkgrtmrydmhgtikeiplhqvslytsrpchivdghgyfllarcpagdsitmefkk
dsvrhscsvpyevkfnpvgrelythppehgveqacqvyahdaqnrgayvemhlpgsevdsslvslsgssvtvtpp
dgtsalvececggtkisetinktkqfsqctkkeqcrayrlqndkwvynsdklpkaagatlkgklhvpflladgkc
tvplapepmitfgfrsvslklhpknptylitrqladephythelisepavrnftvtekgwefvwgnhppkrfwaq
etapgnphglphevithyyhrypmstilglsicaaiatvsvaastwlfcrsrvacltpyrltpnaripfclavlc
cartaraettwesldhlwnnnqqmfwiqlliplaalivvtrllrcvccvvpflvmagaagagayehattmpsqag
isyntivnragyaplpisitptkikliptvnleyvtchyktgmdspaikccgsqectptyrpdeqckvftgvypf
mwggaycfcdtentqvskayvmksddcladhaeaykahtasvqaflnitvgehsivttvyvngetpvnfngvkit
agplstawtpfdrkivqyageiynydfpeygagqpgafgdiqsrtvsssdlyantnlvlqrpkagaihvpytqap
sgfeqwkkdkapslkftapfgceiytnpiraencavgsiplafdipdalftrvsetptlsaaectlnecvyssdf
ggiatvkysasksgkcavhvpsgtatlkeaavelteqgsatihfstanihpefrlqictsyvtckgdchppkdhi
vthpqyhaqtftaavsktawtwltsllggsaviiiiglvlativamyvltnqkhn*

Figure 45A

CMV/R VEEV TC83 strain K65N K67N VLP

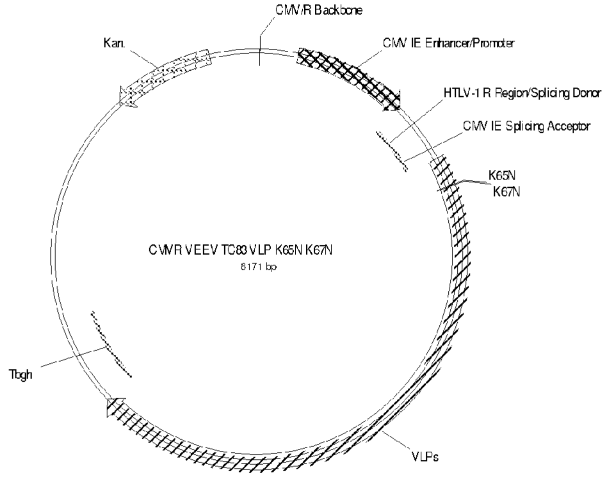

Figure 45B
Insert sequence atgttcccgttccagccaatgtatccgatgcagccaatgccctatcgcaacccgttcgcggccccgcgcaggccc
tggttccccagaaccgacccttttctggcgatgcaggtgcaggaattaacccgctcgatggctaacctgacgttc
aagcaacgccgggacgcgccacctgaggggccatccgctaagaatccgaataaggaggcctcgcaaaaacagaaa
gggggaggccaagggaagaagaagaagaaccaagggaagaagaaggctaagacagggccgcctaatccgaaggca
cagaatggaaacaagaagaagaccaacaagaaaccaggcaagagacagcgcatggtcatgaaattggaatctgac
aagacgttcccaatcatgttggaagggaagataaacggctacgcttgtgtggtcggagggaagttattcaggccg
atgcatgtggaaggcaagatcgacaacgacgttctggccgcgcttaagacgaagaaagcatccaaatacgatctt
gagtatgcagatgtgccacagaacatgcgggccgatacattcaaatacacccatgagaaaccccaaggctattac
agctggcatcatggagcagtccaatatgaaaatgggcgtttcacggtgccgaaaggagttggggccaagggagac
agcggacgacccattctggataaccagggacgggtggtcgctattgtgctgggaggtgtgaatgaaggatctagg
acagccctttcagtcgtcatgtggaacgagaagggagttaccgtgaagtatactccggagaactgcgagcaatgg
tcactagtgaccaccatgtgtctgctcgccaatgtgacgttcccatgtgctcaaccaccaatttgctacgacaga
aaaccagcagagactttggccatgctcagcgttaacgttgacaacccgggctacgatgagctgctggaagcagct
gttaagtgccccggaaggaaaaggagatccaccgaggagctgtttaatgagtataagctaacgcgcccttacatg
gccagatgcatcagatgtgcagttgggagctgccatagtccaatagcaatcgaggcagtaaagagcgacgggcac
gacggttatgttagacttcagacttcctcgcagtatggcctggattcctccggcaacttaaagggcaggaccatg
cggtatgacatgcacgggaccattaaagagataccactacatcaagtgtcactctatacatctcgcccgtgtcac
attgtggatgggcacggttatttcctgcttgccaggtgcccggcaggggactccatcaccatggaatttaagaaa
gattccgtcagacactcctgctcggtgccgtatgaagtgaaatttaatcctgtaggcagagaactctatactcat
cccccagaacacggagtagagcaagcgtgccaagtctacgcacatgatgcacagaacagaggagcttatgtcgag
atgcacctcccgggctcagaagtggacagcagtttggtttccttgagcggcagttcagtcaccgtgacacctcct
gatgggactagcgccctggtggaatgcgagtgtggcggcacaaagatctccgagaccatcaacaagacaaaacag
ttcagccagtgcacaaagaaggagcagtgcagagcatatcggctgcagaacgataagtgggtgtataattctgac
aaactgcccaaagcagcgggagccaccttaaaaggaaaactgcatgtcccattcttgctggcagacggcaaatgc
accgtgcctctagcaccagaacctatgataaccttcggtttcagatcagtgtcactgaaactgcaccctaagaat
cccacatatctaatcacccgccaacttgctgatgagcctcactacacgcacgagctcatatctgaaccagctgtt
aggaattttaccgtcaccgaaaaagggtgggagtttgtatggggaaaccacccgccgaaaaggttttgggcacag
gaaacagcacccggaaatccacatgggctaccgcacgaggtgataactcattattaccacagataccctatgtcc
accatcctgggtttgtcaatttgtgccgccattgcaaccgtttccgttgcagcgtctacctggctgttttgcaga
tctagagttgcgtgcctaactccttaccggctaacacctaacgctaggataccattttgtctggctgtgctttgc
tgcgcccgcactgcccgggccgagaccacctgggagtccttggatcacctatggaacaataaccaacagatgttc
tggattcaattgctgatccctctggccgccttgatcgtagtgactcgcctgctcaggtgcgtgtgctgtgtcgtg
cctttttagtcatggccggcgccgcaggcgccggcgcctacgagcacgcgaccacgatgccgagccaagcggga
atctcgtataacactatagtcaacagagcaggctacgcaccactccctatcagcataacaccaacaaagatcaag
ctgatacctacagtgaacttggagtacgtcacctgccactacaaaacaggaatggattcaccagccatcaaatgc

Figure 45B continued tgcggatctcaggaatgcactccaacttacaggcctgatgaacagtgcaaagtcttcacaggggtttacccgttc
atgtggggtggtgcatattgcttttgcgacactgagaacacccaagtcagcaaggcctacgtaatgaaatctgac
gactgccttgcggatcatgctgaagcatataaagcgcacacagcctcagtgcaggcgttcctcaacatcacagtg
ggagaacactctattgtgactaccgtgtatgtgaatggagaaactcctgtgaatttcaatggggtcaaaataact
gcaggtccgctttccacagcttggacaccctttgatcgcaaaatcgtgcagtatgccggggagatctataattat
gattttcctgagtatggggcaggacaaccaggagcatttggagatatacaatccagaacagtctcaagctctgat
ctgtatgccaataccaacctagtgctgcagagacccaaagcaggagcgatccacgtgccatacactcaggcacct
tcgggttttgagcaatggaagaaagataaagctccatcattgaaatttaccgcccctttcggatgcgaaatatat
acaaaccccattcgcgccgaaaactgtgctgtagggtcaattccattagcctttgacattcccgacgccttgttc
accagggtgtcagaaacaccgacactttcagcggccgaatgcactcttaacgagtgcgtgtattcttccgacttt
ggtgggatcgccacggtcaagtactcggccagcaagtcaggcaagtgcgcagtccatgtgccatcagggactgct
accctaaaagaagcagcagtcgagctaaccgagcaagggtcggcgactatccatttctcgaccgcaaatatccac
ccggagttcaggctccaaatatgcacatcatatgttacgtgcaaaggtgattgtcacccccgaaagaccatatt
gtgacacaccctcagtatcacgcccaaacatttacagccgcggtgtcaaaaaccgcgtggacgtggttaacatcc
ctgctgggaggatcagccgtaattattataattggcttggtgctggctactattgtggccatgtacgtgctgacc
aaccagaaacataattaag Figure 45C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccgttccagccaatgtatccgatgcagccaatgccctatcgc
aacccgttcgcggccccgcgcaggccctggttccccagaaccgaccctttctggcgatgcaggtgcaggaatta
acccgctcgatggctaacctgacgttcaagcaacgccgggacgcgccacctgaggggccatccgctaagaatccg
aataaggaggcctcgcaaaaacagaaagggggaggccaagggaagaagaagaagaaccaagggaagaagaaggct
aagacagggccgcctaatccgaaggcacagaatggaaacaagaagaagaccaacaagaaaccaggcaagagacag
cgcatggtcatgaaattggaatctgacaagacgttcccaatcatgttggaagggaagataaacggctacgcttgt
gtggtcggagggaagttattcaggccgatgcatgtggaaggcaagatcgacaacgacgttctggccgcgcttaag
acgaagaaagcatccaaatacgatcttgagtatgcagatgtgccacagaacatgcgggccgatacattcaaatac
acccatgagaaaccccaaggctattacagctggcatcatggagcagtccaatatgaaaatgggcgtttcacggtg
ccgaaaggagttggggccaagggagacagcggacgacccattctcgataaccagggacgggtggtcgctattgtg
ctgggaggtgtgaatgaaggatctaggacagccctttcagtcgtcatgtggaacgagaagggagttaccgtgaag
tatactccggagaactgcgagcaatggtcactagtgaccaccatgtgtctgctcgccaatgtgacgttcccatgt
gctcaaccaccaatttgctacgacagaaaaccagcagagactttggccatgctcagcgttaacgttgacaacccg
ggctacgatgagctgctggaagcagctgttaagtgccccggaaggaaaaggagatccaccgaggagctgtttaat
gagtataagctaacgcgcccttacatggccagatgcatcagatgtgcagttgggagctgccatagtccaatagca
atcgaggcagtaaagagcgacgggcacgacggttatgttagacttcagacttcctcgcagtatggcctggattcc
tccggcaacttaaagggcaggaccatgcggtatgacatgcacgggaccattaaagagataccactacatcaagtg
tcactctatacatctcgcccgtgtcacattgtggatgggcacggttatttcctgcttgccaggtgcccggcaggg
gactccatcaccatggaatttaagaaagattccgtcagacactcctgctcggtgccgtatgaagtgaaatttaat
cctgtaggcagagaactctatactcatcccccagaacacggagtagagcaagcgtgccaagtctacgcacatgat
gcacagaacagaggagcttatgtcgagatgcacctcccgggctcagaagtggacagcagtttggtttccttgagc
ggcagttcagtcaccgtgacacctcctgatgggactagcgccctggtggaatgcgagtgtggcggcacaaagatc

Figure 45C continued tccgagaccatcaacaagacaaaacagttcagccagtgcacaaagaaggagcagtgcagagcatatcggctgcag
aacgataagtgggtgtataattctgacaaactgcccaaagcagcgggagccaccttaaaggaaaactgcatgtc
ccattcttgctggcagacggcaaatgcaccgtgcctctagcaccagaacctatgataaccttcggtttcagatca
gtgtcactgaaactgcaccctaagaatcccacatatctaatcacccgccaacttgctgatgagcctcactacacg
cacgagctcatatctgaaccagctgttaggaattttaccgtcaccgaaaagggtgggagtttgtatggggaaac
cacccgccgaaaggttttgggcacaggaaacagcacccggaaatccacatgggctaccgcacgaggtgataact
cattattaccacagataccctatgtccaccatcctgggtttgtcaatttgtgccgccattgcaaccgtttccgtt
gcagcgtctacctggctgttttgcagatctagagttgcgtgcctaactccttaccggctaacacctaacgctagg
ataccattttgtctggctgtgctttgctgcgcccgcactgcccgggccgagaccacctgggagtccttggatcac
ctatggaacaataaccaacagatgttctggattcaattgctgatccctctggccgccttgatcgtagtgactcgc
ctgctcaggtgcgtgtgctgtgtcgtgcctttttttagtcatggccggcgccgcaggcgccggcgcctacgagcac
gcgaccacgatgccgagccaagcgggaatctcgtataacactatagtcaacagagcaggctacgcaccactccct
atcagcataacaccaacaaagatcaagctgatacctacagtgaacttggagtacgtcacctgccactacaaaaca
ggaatggattcaccagccatcaaatgctgcggatctcaggaatgcactccaacttacaggcctgatgaacagtgc
aaagtcttcacaggggtttacccgttcatgtggggtggtgcatattgcttttgcgacactgagaacacccaagtc
agcaaggcctacgtaatgaaatctgacgactgccttgcggatcatgctgaagcatataaagcgcacacagcctca
gtgcaggcgttcctcaacatcacagtgggagaacactctattgtgactaccgtgtatgtgaatggagaaactcct
gtgaatttcaatggggtcaaaataactgcaggtccgctttccacagcttggacaccctttgatcgcaaaatcgtg
cagtatgccggggagatctataattatgattttcctgagtatggggcaggacaaccaggagcatttggagatata
caatccagaacagtctcaagctctgatctgtatgccaataccaacctagtgctgcagagacccaaagcaggagcg
atccacgtgccatacactcaggcaccttcgggttttgagcaatggaagaaagataaagctccatcattgaaattt
accgcccctttcggatgcgaaatatatacaaaccccattcgcgccgaaaactgtgctgtagggtcaattccatta
gcctttgacattcccgacgccttgttcaccagggtgtcagaaacaccgacactttcagcggccgaatgcactctt
aacgagtgcgtgtattcttccgactttggtgggatcgccacggtcaagtactcggccagcaagtcaggcaagtgc
gcagtccatgtgccatcagggactgctaccctaaaagaagcagcagtcgagctaaccgagcaagggtcggcgact
atccatttctcgaccgcaaatatccacccggagttcaggctccaaatatgcacatcatatgttacgtgcaaaggt
gattgtcacccccccgaaagaccatattgtgacacaccctcagtatcacgcccaaacatttacagccgcggtgtca
aaaaccgcgtggacgtggttaacatccctgctgggaggatcagccgtaattattataattggcttggtgctggct
actattgtggccatgtacgtgctgaccaaccagaaacataattaaggatccagatctgctgtgccttctagttgc
cagccatctgttgtttgcccctcccccgtgccttccttgaccctggaaggtgccactcccactgtcctttcctaa
taaaatgaggaaattgcatcgcattgtctgagtaggtgtcattctattctggggggtggggtggggcaggacagc
aagggggaggattgggaagacaatagcaggcatgctggggatgcggtgggctctatgggtacccaggtgctgaag
aattgacccggttcctcctgggccagaaagaagcaggcacatccccttctctgtgacacaccctgtccacgcccc
tggttcttagttccagccccactcataggacactcatagctcaggagggctccgccttcaatcccacccgctaaa
gtacttggagcggtctctccctccctcatcagcccaccaaaccaaacctagcctccaagagtgggaagaaattaa
agcaagataggctattaagtgcagagggagagaaaatgcctccaacatgtgaggaagtaatgagagaaatcatag
aattttaaggccatgatttaaggccatcatggccttaatcttccgcttcctcgctcactgactcgctgcgctcgg
tcgttcggctgcggcgagcggtatcagctcactcaaaggcggtaatacggttatccacagaatcaggggataacg
caggaaagaacatgtgagcaaaaggccagcaaaaggccaggaaccgtaaaaaggccgcgttgctggcgtttttcc
ataggctccgcccccctgacgagcatcacaaaaatcgacgctcaagtcagaggtggcgaaacccgacaggactat
aaagataccaggcgtttccccctggaagctccctcgtgcgctctcctgttccgaccctgccgcttaccggatacc
tgtccgcctttctcccttcgggaagcgtggcgctttctcatagctcacgctgtaggtatctcagttcggtgtagg
tcgttcgctccaagctgggctgtgtgcacgaaccccccgttcagcccgaccgctgcgccttatccggtaactatc
gtcttgagtccaacccggtaagacacgacttatcgccactggcagcagccactggtaacaggattagcagagcga
ggtatgtaggcggtgctacagagttcttgaagtggtggcctaactacggctacactagaagaacagtatttggta
tctgcgctctgctgaagccagttaccttcggaaaaagagttggtagctcttgatccggcaaacaaaccaccgctg
gtagcggtggtttttttgtttgcaagcagcagattacgcgcagaaaaaaaggatctcaagaagatcctttgatct
tttctacggggtctgacgctcagtggaacgaaaactcacgttaagggattttggtcatgagattatcaaaaagga
tcttcacctagatccttttaaattaaaaatgaagttttaaatcaatctaaagtatatatgagtaaacttggtctg
acagttaccaatgcttaatcagtgaggcacctatctcagcgatctgtctatttcgttcatccatagttgcctgac
tcggggggggggggcgctgaggtctgcctcgtgaagaaggtgttgctgactcataccaggcctgaatcgccccat
catccagccagaaagtgagggagccacggttgatgagagctttgttgtaggtggaccagttggtgattttgaact
tttgctttgccacggaacggtctgcgttgtcgggaagatgcgtgatctgatccttcaactcagcaaaagttcgat
ttattcaacaaagccgccgtcccgtcaagtcagcgtaatgctctgccagtgttacaaccaattaaccaattctga
ttagaaaaactcatcgagcatcaaatgaaactgcaatttattcatatcaggattatcaataccatatttttgaaa
aagccgtttctgtaatgaaggagaaaactcaccgaggcagttccataggatggcaagatcctggtatcggtctgc
gattccgactcgtccaacatcaatacaacctattaatttcccctcgtcaaaaataaggttatcaagtgagaaatc
accatgagtgacgactgaatccggtgagaatggcaaaagcttatgcatttctttccagacttgttcaacaggcca
gccattacgctcgtcatcaaaatcactcgcatcaaccaaaccgttattcattcgtgattgcgcctgagcgagacg
aaatacgcgatcgctgttaaaggacaattacaaacaggaatcgaatgcaaccggcgcaggaacactgccagcgc
atcaacaatattttcacctgaatcaggatattcttctaatacctggaatgctgttttcccggggatcgcagtggt

Figure 45C continued gagtaaccatgcatcatcaggagtacggataaaatgcttgatggtcggaagaggcataaattccgtcagccagtt
tagtctgaccatctcatctgtaacatcattggcaacgctacctttgccatgtttcagaaacaactctggcgcatc
gggcttcccatacaatcgatagattgtcgcacctgattgcccgacattatcgcgagcccatttatacccatataa
atcagcatccatgttggaatttaatcgcggcctcgagcaagacgtttcccgttgaatatggctcataacacccct
tgtattactgtttatgtaagcagacagttttattgttcatgatgatatatttttatcttgtgcaatgtaacatca
gagattttgagacacaacgtggctttcccccccccccccattattgaagcatttatcagggttattgtctcatgag
cggatacatatttgaatgtatttagaaaaataaacaaataggggttccgcgcacatttccccgaaaagtgccacc
tgacgtctaagaaaccattattatcatgacattaacctataaaaataggcgtatcacgaggccctttcgtc Figure 45D
Capsid AA sequence mfpfqpmypmqpmpyrnpfaaprrpwfprtdpflamqvqeltrsmanltfkqrrdappegpsaknpnkeasqkqk
gggqgkkkknqgkkkaktgppnpkaqngnkkktnkkpgkrqrmvmklesdktfpimlegkingyacvvggklfrp
mhvegkidndvlaalktkkaskydleyadvpqnmradtfkythekpqgyyswhhgavqyengrftvpkgvgakgd
sgrpildnqgrvvaivlggvnegsrtalsvvmwnekgvtvkytpenceqwslvttmcllanvtfpcaqppicydr
kpaetlamlsvnvdnpgydelleaavkcpgrkrrsteelfneykltrpymarcircavgschspiaieavksdgh
dgyvrlqtssqygldssgnlkgrtmrydmhgtikeiplhqvslytsrpchivdghgyfllarcpagdsitmefkk
dsvrhscsvpyevkfnpvgrelythppehgveqacqvyahdaqnrgayvemhlpgsevdsslvslsgssvtvtpp
dgtsalvececggtkisetinktkqfsqctkkeqcrayrlqndkwvynsdklpkaagatlkgklhvpflladgkc
tvplapepmitfgfrsvslklhpknptylitrqladephythelisepavrnftvtekgwefvwgnhppkrfwaq
etapgnphglphevithyyhrypmstilglsicaaiatvsvaastwlfcrsrvacltpyrltpnaripfclavlc
cartaraettwesldhlwnnnqqmfwiqllliplaalivvtrllrcvccvvpflvmagaagagayehattmpsqag
isyntivnragyaplpisitptkikliptvnleyvtchyktgmdspaikccgsqectptyrpdeqckvftgvypf
mwggaycfcdtentqvskayvmksddcladhaeaykahtasvqaflnitvgehsivttvyvngetpvnfngvkit
agplstawtpfdrkivqyageiynydfpeygagqpgafgdiqsrtvsssdlyantnlvlqrpkagaihvpytqap
sgfeqwkkdkapslkftapfgceiytnpiraencavgsiplafdipdalftrvsetptlsaaectlnecvyssdf
ggiatvkysasksgkcavhvpsgtatlkeaaveltegqsatihfstanihpefrlqictsyvtckgdchppkdhi
vthpqyhaqtftaavsktawtwltsllggsaviiiiglvlativamyvltnqkhn*

Figure 46A

CMV/R VEEV TC83 strain K65A K67A VLP

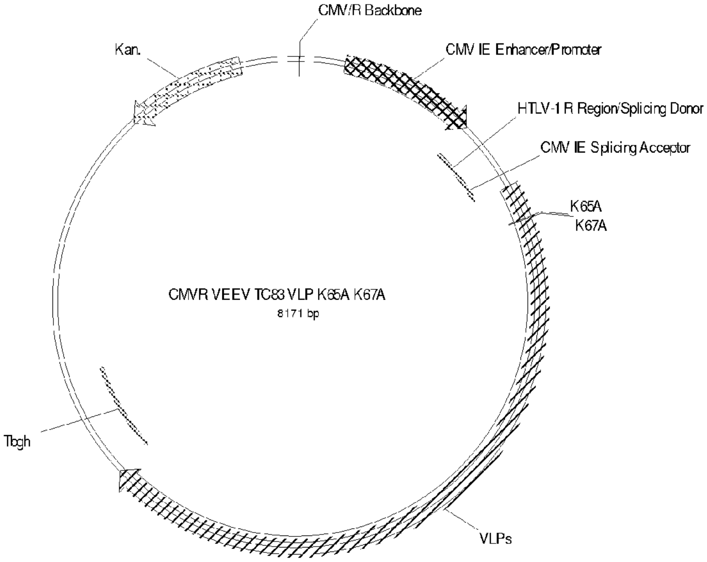

Figure 46B
Insert sequence atgttcccgttccagccaatgtatccgatgcagccaatgccctatcgcaacccgttcgcggccccgcgcaggccc
tggttccccagaaccgacccttttctggcgatgcaggtgcaggaattaacccgctcgatggctaacctgacgttc
aagcaacgccgggacgcgccacctgaggggccatccgctaaggcaccggcgaaggaggcctcgcaaaaacagaaa
gggggaggccaagggaagaagaagaagaaccaagggaagaagaaggctaagacagggccgcctaatccgaaggca
cagaatggaaacaagaagaagaccaacaagaaaccaggcaagagacagcgcatggtcatgaaattggaatctgac
aagacgttcccaatcatgttggaagggaagataaacggctacgcttgtgtggtcggagggaagttattcaggccg
atgcatgtggaaggcaagatcgacaacgacgttctggccgcgcttaagacgaagaaagcatccaaatacgatctt
gagtatgcagatgtgccacagaacatgcgggccgatacattcaaatacacccatgagaaaccccaaggctattac
agctggcatcatggagcagtccaatatgaaaatgggcgtttcacggtgccgaaaggagttggggccaagggagac
agcggacgacccattctggataaccagggacgggtggtcgctattgtgctgggaggtgtgaatgaaggatctagg
acagccctttcagtcgtcatgtggaacgagaagggagttaccgtgaagtatactccggagaactgcgagcaatgg
tcactagtgaccaccatgtgtctgctcgccaatgtgacgttcccatgtgctcaaccaccaatttgctacgacaga
aaaccagcagagactttggccatgctcagcgttaacgttgacaacccgggctacgatgagctgctggaagcagct
gttaagtgccccggaaggaaaaggagatccaccgaggagctgtttaatgagtataagctaacgcgcccttacatg
gccagatgcatcagatgtgcagttgggagctgccatagtccaatagcaatcgaggcagtaaagagcgacgggcac
gacggttatgttagacttcagacttcctcgcagtatggcctggattcctccggcaacttaaagggcaggaccatg
cggtatgacatgcacgggaccattaaagagataccactacatcaagtgtcactctatacatctcgcccgtgtcac
attgtggatgggcacggttatttcctgcttgccaggtgcccggcaggggactccatcaccatggaatttaagaaa
gattccgtcagacactcctgctcggtgccgtatgaagtgaaatttaatcctgtaggcagagaactctatactcat
cccccagaacacggagtagagcaagcgtgccaagtctacgcacatgatgcacagaacagaggagcttatgtcgag
atgcacctcccgggctcagaagtggacagcagtttggtttccttgagcggcagttcagtcaccgtgacacctcct
gatgggactagcgccctggtggaatgcgagtgtggcggcacaaagatctccgagaccatcaacaagacaaaacag
ttcagccagtgcacaaagaaggagcagtgcagagcatatcggctgcagaacgataagtgggtgtataattctgac
aaactgcccaaagcagcgggagccaccttaaaaggaaaactgcatgtcccattcttgctggcagacggcaaatgc
accgtgcctctagcaccagaacctatgataaccttcggtttcagatcagtgtcactgaaactgcaccctaagaat
cccacatatctaatcacccgccaacttgctgatgagcctcactacacgcacgagctcatatctgaaccagctgtt
aggaattttaccgtcaccgaaaaagggtgggagtttgtatggggaaaccacccgccgaaaaggttttgggcacag
gaaacagcacccggaaatccacatgggctaccgcacgaggtgataactcattattaccacagataccctatgtcc
accatcctgggtttgtcaatttgtgccgccattgcaaccgtttccgttgcagcgtctacctggctgttttgcaga
tctagagttgcgtgcctaactccttaccggctaacacctaacgctaggataccatttttgtctggctgtgctttgc
tgcgcccgcactgcccgggccgagaccacctgggagtccttggatcacctatggaacaataaccaacagatgttc
tggattcaattgctgatccctctggccgccttgatcgtagtgactcgcctgctcaggtgcgtgtgctgtgtcgtg

Figure 46B continued cctttttagtcatggccggcgccgcaggcgccggcgcctacgagcacgcgaccacgatgccgagccaagcggga
atctcgtataacactatagtcaacagagcaggctacgcaccactccctatcagcataacaccaacaaagatcaag
ctgatacctacagtgaacttggagtacgtcacctgccactacaaacaggaatggattcaccagccatcaaatgc
tgcggatctcaggaatgcactccaacttacaggcctgatgaacagtgcaaagtcttcacaggggtttacccgttc
atgtggggtggtgcatattgcttttgcgacactgagaacacccaagtcagcaaggcctacgtaatgaaatctgac
gactgccttgcggatcatgctgaagcatataaagcgcacacagcctcagtgcaggcgttcctcaacatcacagtg
ggagaacactctattgtgactaccgtgtatgtgaatggagaaactcctgtgaatttcaatggggtcaaaataact
gcaggtccgctttccacagcttggacaccctttgatcgcaaaatcgtgcagtatgccggggagatctataattat
gattttcctgagtatggggcaggacaaccaggagcatttggagatatacaatccagaacagtctcaagctctgat
ctgtatgccaataccaacctagtgctgcagagacccaaagcaggagcgatccacgtgccatacactcaggcacct
tcgggttttgagcaatggaagaaagataaagctccatcattgaaatttaccgcccctttcggatgcgaaatatat
acaaaccccattcgcgccgaaaactgtgctgtagggtcaattccattagcctttgacattcccgacgccttgttc
accagggtgtcagaaacaccgacactttcagcggccgaatgcactcttaacgagtgcgtgtattcttccgacttt
ggtgggatcgccacggtcaagtactcggccagcaagtcaggcaagtgcgcagtccatgtgccatcagggactgct
accctaaaagaagcagcagtcgagctaaccgagcaaggtcggcgactatccatttctcgaccgcaaatatccac
ccggagttcaggctccaaatatgcacatcatatgttacgtgcaaaggtgattgtcacccccgaaagaccatatt
gtgacacaccctcagtatcacgcccaaacatttacagccgcggtgtcaaaaaccgcgtggacgtggttaacatcc
ctgctgggaggatcagccgtaattattataattggcttggtgctggctactattgtggccatgtacgtgctgacc
aaccagaaacataattaag Figure 46C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccgttccagccaatgtatccgatgcagccaatgccctatcgc
aacccgttcgcggccccgcgcaggccctggttccccagaaccgacccttttctggcgatgcaggtgcaggaatta
acccgctcgatggctaacctgacgttcaagcaacgccgggacgcgccacctgaggggccatccgctaaggcaccg
gcgaaggaggcctcgcaaaaacagaaagggggaggccaagggaagaagaagaagaaccaagggaagaagaaggct
aagacagggccgcctaatccgaaggcacagaatggaaacaagaagaagaccaacaagaaaccaggcaagagacag
cgcatggtcatgaaattggaatctgacaagacgttcccaatcatgttggaaggaagataaacggctacgcttgt
gtggtcggagggaagttattcaggccgatgcatgtggaaggcaagatcgacaacgacgttctggccgcgcttaag
acgaagaaagcatccaaatacgatcttgagtatgcagatgtgccacagaacatgcgggccgatacattcaaatac
acccatgagaaaccccaaggctattacagctggcatcatggagcagtccaatatgaaaatggcgtttcacggtg
ccgaaaggagttggggccaagggagacagcggacgacccattctggataaccaggacgggtggtcgctattgtg
ctgggaggtgtgaatgaaggatctaggacagccctttcagtcgtcatgtggaacgagaagggagttaccgtgaag
tatactccggagaactgcgagcaatggtcactagtgaccaccatgtgtctgctcgccaatgtgacgttcccatgt
gctcaaccaccaatttgctacgacagaaaaccagcagagactttggccatgctcagcgttaacgttgacaacccg
ggctacgatgagctgctggaagcagctgttaagtgccccggaaggaaaaggagatccaccgaggagctgtttaat
gagtataagctaacgcgcccttacatggccagatgcatcagatgtgcagttggcagctgccatagtccaatagca
atcgaggcagtaaagagcgacgggcacgacggttatgttagacttcagacttcctcgcagtatggcctggattcc
tccggcaacttaaagggcaggaccatgcggtatgacatgcacgggaccattaaagagataccactacatcaagtg
tcactctatacatctcgcccgtgtcacattgtggatgggcacggttatttcctgcttgccaggtgcccggcaggg

Figure 46C continued gactccatcaccatggaatttaagaaagattccgtcagacactcctgctcggtgccgtatgaagtgaaatttaat
cctgtaggcagagaactctatactcatccccagaacacggagtagagcaagcgtgccaagtctacgcacatgat
gcacagaacagaggagcttatgtcgagatgcacctcccgggctcagaagtggacagcagtttggtttccttgagc
ggcagttcagtcaccgtgacacctcctgatggactagcgccctggtggaatgcgagtgtggcggcacaaagatc
tccgagaccatcaacaagacaaaacagttcagccagtgcacaaagaaggagcagtgcagagcatatcggctgcag
aacgataagtgggtgtataattctgacaaactgcccaaagcagcgggagccaccttaaaggaaaactgcatgtc
ccattcttgctggcagacggcaaatgcaccgtgcctctagcaccagaacctatgataaccttcggtttcagatca
gtgtcactgaaactgcaccctaagaatcccacatatctaatcacccgccaacttgctgatgagcctcactacacg
cacgagctcatatctgaaccagctgttaggaatttaccgtcaccgaaaaagggtgggagtttgtatgggaaac
cacccgccgaaaaggtttgggcacaggaaacagcacccggaaatccacatgggctaccgcacgaggtgataact
cattattaccacagataccctatgtccaccatcctgggtttgtcaatttgtgccgccattgcaaccgtttccgtt
gcagcgtctacctggctgttttgcagatctagagttgcgtgcctaactccttaccggctaacacctaacgctagg
ataccattttgtctggctgtgctttgctgcgcccgcactgcccgggccgagaccacctgggagtccttggatcac
ctatggaacaataaccaacagatgttctggattcaattgctgatccctctggccgccttgatcgtagtgactcgc
ctgctcaggtgcgtgtgctgtgtcgtgcctttttttagtcatggccggcgccgcaggcgccggcgcctacgagcac
gcgaccacgatgccgagccaagcgggaatctcgtataacactatagtcaacagagcaggctacgcaccactccct
atcagcataacaccaacaaagatcaagctgatacctacagtgaacttggagtacgtcacctgccactacaaaaca
ggaatggattcaccagccatcaaatgctgcggatctcaggaatgcactccaacttacaggcctgatgaacagtgc
aaagtcttcacaggggtttacccgttcatgtggggtggtgcatattgcttttgcgacactgagaacacccaagtc
agcaaggcctacgtaatgaaatctgacgactgccttgcggatcatgctgaagcatataaagcgcacacagcctca
gtgcaggcgttcctcaacatcacagtgggagaacactctattgtgactaccgtgtatgtgaatggagaaactcct
gtgaatttcaatggggtcaaaataactgcaggtccgctttccacagcttggacaccctttgatcgcaaaatcgtg
cagtatgccggggagatctataattatgattttcctgagtatggggcaggacaaccaggagcatttggagatata
caatccagaacagtctcaagctctgatctgtatgccaataccaacctagtgctgcagagacccaaagcaggagcg
atccacgtgccatacactcaggcaccttcgggttttgagcaatggaagaaagataaagctccatcattgaaattt
accgcccctttcggatgcgaaatatatacaaaccccattcgcgccgaaaactgtgctgtagggtcaattccatta
gcctttgacattcccgacgccttgttcaccagggtgtcagaaacaccgacactttcagcggccgaatgcactctt
aacgagtgcgtgtattcttccgactttggtgggatcgccacggtcaagtactcggccagcaagtcaggcaagtgc
gcagtccatgtgccatcagggactgctaccctaaaagaagcagcagtcgagctaaccgagcaagggtcggcgact
atccatttctcgaccgcaaatatccacccggagttcaggctccaaatatgcacatcatatgttacgtgcaaaggt
gattgtcacccccgaaagaccatattgtgacacaccctcagtatcacgcccaaacatttacagccgcggtgtca
aaaaccgcgtggacgtggttaacatccctgctgggaggatcagccgtaattattataattggcttggtgctggct
actattgtggccatgtacgtgctgaccaaccagaaacataattaaggatccagatctgctgtgccttctagttgc
cagccatctgttgtttgcccctcccccgtgccttccttgaccctggaaggtgccactcccactgtcctttcctaa
taaaatgaggaaattgcatcgcattgtctgagtaggtgtcattctattctggggggtggggtggggcaggacagc
aagggggaggattgggaagacaatagcaggcatgctggggatgcggtgggctctatgggtacccaggtgctgaag
aattgacccggttcctcctgggccagaaagaagcaggcacatccccttctctgtgacacaccctgtccacgcccc
tggttcttagttccagccccactcataggacactcatagctcaggagggctccgccttcaatcccacccgctaaa
gtacttggagcggtctctccctccctcatcagcccaccaaaccaaacctagcctccaagagtgggaagaaattaa
agcaagataggctattaagtgcagagggagagaaaatgcctccaacatgtgaggaagtaatgagagaaatcatag
aattttaaggccatgatttaaggccatcatggccttaatcttccgcttcctcgctcactgactcgctgcgctcgg
tcgttcggctgcggcgagcggtatcagctcactcaaaggcggtaatacggttatccacagaatcaggggataacg
caggaaagaacatgtgagcaaaaggccagcaaaaggccaggaaccgtaaaaaggccgcgttgctggcgtttttcc
ataggctccgcccccctgacgagcatcacaaaaatcgacgctcaagtcagaggtggcgaaacccgacaggactat
aaagataccaggcgtttccccctggaagctccctcgtgcgctctcctgttccgaccctgccgcttaccggatacc
tgtccgcctttctcccttcgggaagcgtggcgctttctcatagctcacgctgtaggtatctcagttcggtgtagg
tcgttcgctccaagctgggctgtgtgcacgaaccccccgttcagcccgaccgctgcgccttatccggtaactatc
gtcttgagtccaacccggtaagacacgacttatcgccactggcagcagccactggtaacaggattagcagagcga
ggtatgtaggcggtgctacagagttcttgaagtggtggcctaactacggctacactagaagaacagtatttggta
tctgcgctctgctgaagccagttaccttcggaaaaagagttggtagctcttgatccggcaaacaaaccaccgctg
gtagcggtggtttttttgtttgcaagcagcagattacgcgcagaaaaaaaggatctcaagaagatcctttgatct
tttctacggggtctgacgctcagtggaacgaaaactcacgttaagggattttggtcatgagattatcaaaaagga
tcttcacctagatccttttaaattaaaaatgaagttttaaatcaatctaaagtatatatgagtaaacttggtctg
acagttaccaatgcttaatcagtgaggcacctatctcagcgatctgtctatttcgttcatccatagttgcctgac
tcgggggggggggcgctgaggtctgcctcgtgaagaaggtgttgctgactcataccaggcctgaatcgccccat
catccagccagaaagtgagggagccacggttgatgagagctttgttgtaggtggaccagttggtgattttgaact
tttgctttgccacggaacggtctgcgttgtcgggaagatgcgtgatctgatccttcaactcagcaaaagttcgat
ttattcaacaaagccgccgtcccgtcaagtcagcgtaatgctctgccagtgttacaaccaattaaccaattctga
ttagaaaaactcatcgagcatcaaatgaaactgcaatttattcatatcaggattatcaataccatatttttgaaa
aagccgtttctgtaatgaaggagaaaactcaccgaggcagttccataggatggcaagatcctggtatcggtctgc
gattccgactcgtccaacatcaatacaacctattaatttcccctcgtcaaaataaggttatcaagtgagaaatc

Figure 46C continued accatgagtgacgactgaatccggtgagaatggcaaaagcttatgcatttctttccagacttgttcaacaggcca
gccattacgctcgtcatcaaaatcactcgcatcaaccaaaccgttattcattcgtgattgcgcctgagcgagacg
aaatacgcgatcgctgttaaaaggacaattacaaacaggaatcgaatgcaaccggcgcaggaacactgccagcgc
atcaacaatattttcacctgaatcaggatattcttctaatacctggaatgctgttttcccggggatcgcagtggt
gagtaaccatgcatcatcaggagtacggataaaatgcttgatggtcggaagaggcataaattccgtcagccagtt
tagtctgaccatctcatctgtaacatcattggcaacgctacctttgccatgtttcagaaacaactctggcgcatc
gggcttcccatacaatcgatagattgtcgcacctgattgcccgacattatcgcgagcccatttatacccatataa
atcagcatccatgttggaatttaatcgcggcctcgagcaagacgtttcccgttgaatatggctcataacacccct
tgtattactgtttatgtaagcagacagttttattgttcatgatgatatatttttatcttgtgcaatgtaacatca
gagattttgagacacaacgtggctttccccccccccccattattgaagcatttatcagggttattgtctcatgag
cggatacatatttgaatgtatttagaaaaataaacaaataggggttccgcgcacatttccccgaaaagtgccacc
tgacgtctaagaaaccattattatcatgacattaacctataaaaataggcgtatcacgaggccctttcgtc Figure 46D
Capsid AA sequence mfpfqpmypmqpmpyrnpfaaprrpwfprtdpflamqvqeltrsmanltfkqrrdappegpsakapakeasqkqk
gggqgkkkknqgkkkaktgppnpkaqngnkkktnkkpgkrqrmvmklesdktfpimlegkingyacvvggklfrp
mhvegkidndvlaalktkkaskydleyadvpqnmradtfkythekpqgyyswhhgavqyengrftvpkgvgakgd
sgrpildnqgrvvaivlggvnegsrtalsvvmwnekgvtvkytpenceqwslvttmcllanvtfpcaqppicydr
kpaetlamlsvnvdnpgydelleaavkcpgrkrrsteelfneykltrpymarcircavgschspiaieavksdgh
dgyvrlqtssqygldssgnlkgrtmrydmhgtikeiplhqvslytsrpchivdghgyfllarcpagdsitmefkk
dsvrhscsvpyevkfnpvgrelythppehgveqacqvyahdaqnrgayvemhlpgsevdsslvslsgssvtvtpp
dgtsalvececggtkisetinktkqfsqctkkeqcrayrlqndkwvynsdklpkaagatlkgklhvpflladgkc
tvplapepmitfgfrsvslklhpknptylitrqladephythelisepavrnftvtekgwefvwgnhppkrfwaq
etapgnphglphevithyyhrypmstilglsicaaiatvsvaastwlfcrsrvacltpyrltpnaripfclavlc
cartaraettwesldhlwnnnqqmfwiqlliplaalivvtrllrcvccvvpflvmagaagagayehattmpsqag
isyntivnragyaplpisitptkikliptvnleyvtchyktgmdspaikccgsqectptyrpdeqckvftgvypf
mwggaycfcdtentqvskayvmksddcladhaeaykahtasvqaflnitvgehsivttvyvngetpvnfngvkit
agplstawtpfdrkivqyageiynydfpeygagqpgafgdiqsrtvsssdlyantnlvlqrpkagaihvpytqap
sgfeqwkkdkapslkftapfgceiytnpiraencavgsiplafdipdalftrvsetptlsaaectlnecvyssdf
ggiatvkysasksgkcavhvpsgtatlkeaavelteqgsatihfstanihpefrlqictsyvtckgdchppkdhi
vthpqyhaqtftaavsktawtwltsllggsaviiiiglvlativamyvltnqkhn*

Figure 47A

CMV/R EEEV PE-6 strain capsid K67N VLP

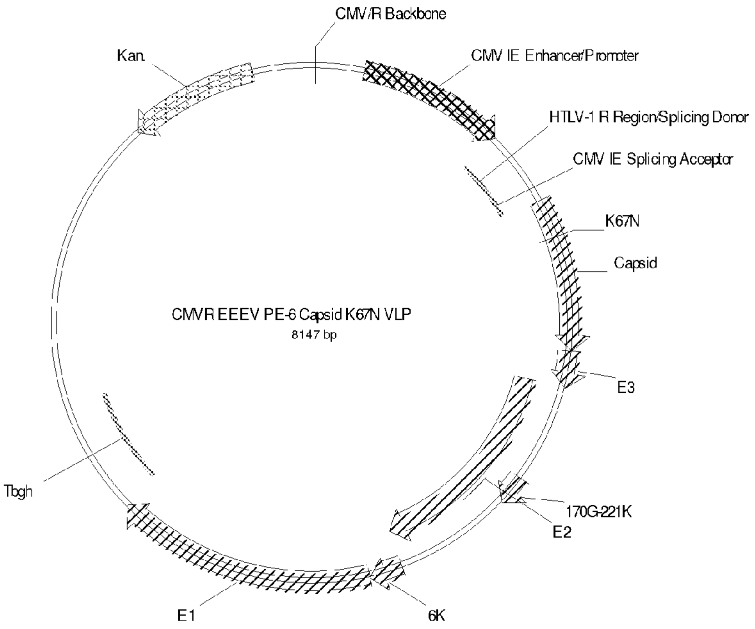

Figure 47B
Capsid insert sequence atgttcccataccctacacttaactacccgcctatggcgccgatcaacccgatggcttaccgggatcctaatccg
cctaggcgcaggtggcggccctttaggccaccacttgcagctcaaattgaggacctgagacgttccattgctagc
ctgactttgaaacaacgagcacctaatcctccagcaggaccgcccgccaatcgcaagaagcctgcgcccaagcct
aagcctgcgcaggcgaaaaagaaacgaccaccaccacctgccaagaaacaaaaacgtaaacctaaaccaggcaaa
cgacagcgaatgtgtatgaagctagagtcagataaaacgtttccgatcatgttgaacggacaggtgaatggttac
gcgtgcgtcgtgggtggacgagtgtttaaaccgctgcacgtagaaggcagaatagacaatgagcaactggccgcc
atcaagctgaagaaggccagcatatatgaccttgagtacggtgatgtgccacaatgcatgaaatcagataccctc
cagtacaccagtgacaagcctcctggcttttataactggcatcatggagctgtacagtatgagaacaataggttc
accgtaccacgaggggtcggtggaaagggtgacagcgggagacctattcttgacaacaaaggtagagtcgtcgca
attgtcctgggtggagtcaacgaaggatccaggacggctctatcagtggtgacatggaaccaaaaaggggttaca
gtcaaagatacaccagaggggtcagagccatgg Figure 47C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag

Figure 47C continued agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccatacctacacttaactacccgcctatggcgccgatcaac
ccgatggcttaccgggatcctaatccgcctaggcgcaggtggcggccctttaggccaccacttgcagctcaaatt
gaggacctgagacgttccattgctagcctgactttgaaacaacgagcacctaatcctccagcaggaccgcccgcc
aatcgcaagaagcctgcgcccaagcctaagcctgcgcaggcgaaaaagaaacgaccaccaccacctgccaagaaa
caaaaacgtaaacctaaaccaggcaaacgacagcgaatgtgtatgaagctagagtcagataaaacgtttccgatc
atgttgaacggacaggtgaatggttacgcgtgcgtcgtgggtggacgagtgtttaaaccgctgcacgtagaaggc
agaatagacaatgagcaactggccgccatcaagctgaagaaggccagcatatatgaccttgagtacggtgatgtg
ccacaatgcatgaaatcagataccctccagtacaccagtgacaagcctcctggcttttataactggcatcatgga
gctgtacagtatgagaacaataggttcaccgtaccacgaggggtcggtggaaagggtgacagcgggagacctatt
cttgacaacaaaggtagagtcgtcgcaattgtcctgggtggagtcaacgaaggatccaggacggctctatcagtg
gtgacatggaaccaaaaaggggttacagtcaaagatacaccagaggggtcagagccatggtcgcttgccactgtc
atgtgcgtcctggccaatatcacgtttccatgtgatcaaccaccctgcatgccatgctgttatgaaaagaatcca
cacgaaacactcaccatgttggaacagaattacgacagccgagcctatgatcagctgctcgatgccgctgtgaaa
tgtaatgctaggagaaccaggagagatttggacactcatttcacccagtataagctggcacgcccgtatattgct
gattgccctaactgtgggcatagtcggtgcgacagccctatagctatagaagaagtcagaggggatgcgcatgca
ggagtcatccgcatccagacatcagctatgttcggtctgaagacggatggagtcgatttggcctacatgagtttc
atgaacggcaaaacgcagaaatcaataaagatcgacaacctgcatgtgcgcacctcagccccttgttccctcgtg
tcgcaccacggctattacatcctggctcaatgcccaccaggagacacggttacagttgggtttcacgacgggcct
aaccgccatacgtgcacagttgcccataaggtagaattcaggccagtgggtagagagaaataccgtcacccacca
gaacatggagttgaattaccatgcaaccgttacactcacaagcgtgcagaccaaggacactacgttgagatgcat
caacccgggctagttgccgaccactctctccttagcatccacagtgccaaggtgaaaattacggtaccgagcggc
gcccaggtgaaatactactgcaagtgcccagatgtacgaaagggaattaccagcagcgaccatacaaccacctgc
acggatgtcaaacaatgcagggcttacctgattgacaacaaaaaatgggtgtacaactctggaagactgcctcga
ggagagggcgacacttttaaaggaaaacttcatgtgccctttgtgcctgttaaggccaagtgcatcgccacgctg
gcaccagagcctctagttgagcacaaacaccgcaccctgatttacacctgcacccggaccatccgaccttgctg
acgaccaggtcacttggaagtgatgcaaatccaactcgacaatggattgagcgaccaacaactgtcaatttcaca
gtcaccggagaagggttggagtatacctggggaaaccatccaccaaaaagagtatgggctcaagagtcaggagaa
gggaatccacacggatggccgcacgaagtggtagtctattactacaacagatacccattaaccacaattatcggg
ttatgcacctgtgtggctatcatcatggtctcttgtgtcacatccgtgtggctcctttgcagaactcgcaatctt
tgcataaccccgtataaactagccccgaacgctcaagtcccaatactcctggcgttactttgctgcattaagccg
acgagggcagatgacaccttgcaagtgctgaattacctgtggaacaacaatcaaaactttttctggatgcagacg
cttatcccacttgcagcgcttatcgtatgcatgcgcatgctgcgctgcttattttgctgtgggccggcttttta
cttgtctgcggcgccttgggcgccgcagcgtacgaacacacagcagtgatgccgaacaaggtggggatcccgtat
aaagctttagtcgaacgcccaggttacgcacccgttcacctacagatacagctggttaataccaggataattcca
tcaactaacctggagtacatcacctgcaagtataagacaaaagtgccttctccagtagtgaaatgctgcggtgcc
actcaatgtacctccaaaccccatcctgactatcagtgtcaggtgttttcaggtgtttacccattcatgtgggga
ggagcctactgcttctgcgacactgaaaacacccagatgagcgaggcgtatgtagagcgctcggaagagtgctct
attgaccacgcaaaagcttataaagtacacacaggcactgttcaggcaatggtaaacataacttatgggagcgtc
agctggagatctgcagatgtttacgtcaatggtgaaactcccgcgaaaataggagatgccaaactcatcataggt
ccactgtcatcagcgtggtccccattcgataacaaggtggtggtttatgggcatgaagtgtataattacgacttt
cctgagtacggcaccggcaaagcaggctcttttggagacctgcaatcacgcacatcaaccagcaacgatctgtac
gcaaacaccaacttgaagctacaacgaccccaggctggtatcgtgcacacacctttcacccaggtgccctctggc
ttcgaacgatggaaaaaggacaaaggggcaccgttgaacgacgtagccccgtttggctgttcgattgccctggag
ccgctccgtgcagaaaattgtgcagtgggaagcatccctatatctatagatatacccgatgcggctttcaccaga
atatctgaaacaccgacagtctcagacctggaatgcaaaattacggagtgtacttatgccttcgatttcggtggt
atagccaccgttgcctacaaatccagtaaagcaggaaactgtccaattcattctccatcaggtgttgcagttatt
aaagagaatgacgtcacgcttgctgagagcggatcatttacattccacttctccactgcaaacatccatcctgct
tttaagctgcaggtctgcactagtgcagttacctgcaaaggagattgtaagccaccgaaagaccacatcgtcgat
tatccagcacaacatactgaatcctttacgtcggcgatatccgccaccgcgtggtcgtggataaaagtgctggta
ggaggaacatcagcatttatcgttctggggcttattgctacagcagtggttgccctagttctgttcttccataga
cattaatctagaccaggccctggatccagatctgctgtgccttctagttgccagccatctgttgtttgcccctcc
cccgtgccttccttgaccctggaaggtgccactcccactgtcctttcctaataaaatgaggaaattgcatcgcat
tgtctgagtaggtgtcattctattctggggggtggggtggggcaggacagcaagggggaggattgggaagacaat
agcaggcatgctggggatgcggtgggctctatgggtacccaggtgctgaagaattgacccggttcctcctgggcc
agaaagaagcagcacatccccttctctgtgacacaccctgtccacgcccctggttcttagttccagccccactc

Figure 47C continued ataggacactcatagctcaggagggctccgccttcaatcccacccgctaaagtacttggagcggtctctccctcc
ctcatcagcccaccaaaccaaacctagcctccaagagtgggaagaaattaaagcaagataggctattaagtgcag
agggagagaaaatgcctccaacatgtgaggaagtaatgagagaaatcatagaattttaaggccatgatttaaggc
catcatggccttaatcttccgcttcctcgctcactgactcgctgcgctcggtcgttcggctgcggcgagcggtat
cagctcactcaaaggcggtaatacggttatccacagaatcaggggataacgcaggaaagaacatgtgagcaaaag
gccagcaaaaggccaggaaccgtaaaaaggccgcgttgctggcgtttttccataggctccgcccccctgacgagc
atcacaaaaatcgacgctcaagtcagaggtggcgaaacccgacaggactataaagataccaggcgtttccccctg
gaagctccctcgtgcgctctcctgttccgaccctgccgcttaccggatacctgtccgcctttctcccttcgggaa
gcgtggcgctttctcatagctcacgctgtaggtatctcagttcggtgtaggtcgttcgctccaagctgggctgtg
tgcacgaaccccccgttcagcccgaccgctgcgccttatccggtaactatcgtcttgagtccaacccggtaagac
acgacttatcgccactggcagcagccactggtaacaggattagcagagcgaggtatgtaggcggtgctacagagt
tcttgaagtggtggcctaactacggctacactagaagaacagtatttggtatctgcgctctgctgaagccagtta
ccttcggaaaaagagttggtagctcttgatccggcaaacaaaccaccgctggtagcggtggtttttttgtttgca
agcagcagattacgcgcagaaaaaaaggatctcaagaagatcctttgatcttttctacggggtctgacgctcagt
ggaacgaaaactcacgttaagggattttggtcatgagattatcaaaaaggatcttcacctagatccttttaaatt
aaaaatgaagttttaaatcaatctaaagtatatatgagtaaacttggtctgacagttaccaatgcttaatcagtg
aggcacctatctcagcgatctgtctatttcgttcatccatagttgcctgactcgggggggggggggcgctgaggtc
tgcctcgtgaagaaggtgttgctgactcataccaggcctgaatcgccccatcatccagccagaaagtgagggagc
cacggttgatgagagctttgttgtaggtggaccagttggtgattttgaacttttgctttgccacggaacggtctg
cgttgtcgggaagatgcgtgatctgatccttcaactcagcaaaagttcgatttattcaacaaagccgccgtcccg
tcaagtcagcgtaatgctctgccagtgttacaaccaattaaccaattctgattagaaaaactcatcgagcatcaa
atgaaactgcaatttattcatatcaggattatcaataccatatttttgaaaaagccgtttctgtaatgaaggaga
aaactcaccgaggcagttccataggatggcaagatcctggtatcggtctgcgattccgactcgtccaacatcaat
acaacctattaatttcccctcgtcaaaaataaggttatcaagtgagaaatcaccatgagtgacgactgaatccgg
tgagaatggcaaaagcttatgcatttctttccagacttgttcaacaggccagccattacgctcgtcatcaaaatc
actcgcatcaaccaaaccgttattcattcgtgattgcgcctgagcgagacgaaatacgcgatcgctgttaaaagg
acaattacaaacaggaatcgaatgcaaccggcgcaggaacactgccagcgcatcaacaatattttcacctgaatc
aggatattcttctaatacctggaatgctgttttcccggggatcgcagtggtgagtaaccatgcatcatcaggagt
acggataaaatgcttgatggtcggaagaggcataaattccgtcagccagtttagtctgaccatctcatctgtaac
atcattggcaacgctacctttgccatgtttcagaaacaactctggcgcatcgggcttcccatacaatcgatagat
tgtcgcacctgattgcccgacattatcgcgagcccatttatacccatataaatcagcatccatgttggaatttaa
tcgcggcctcgagcaagacgtttcccgttgaatatggctcataacaccccttgtattactgtttatgtaagcaga
cagttttattgttcatgatgatatatttttatcttgtgcaatgtaacatcagagattttgagacacaacgtggct
ttcccccccccccccattattgaagcatttatcagggttattgtctcatgagcggatacatatttgaatgtattta
gaaaaataaacaaataggggttccgcgcacatttccccgaaaagtgccacctgacgtctaagaaaccattattat
catgacattaacctataaaaataggcgtatcacgaggccctttcgtc Figure 47D
Capsid AA sequence mfpyptlnyppmapinpmayrdpnpprrrwrpfrpplaaqiedlrrsiasltlkqrapnppagppanrkkpapkp
kpaqakkkrppppakkqkrkpkpgkrqrmcmklesdktfpimlngqvngyacvvggrvfkplhvegridneqlaa
iklkkasiydleygdvpqcmksdtlqytsdkppgfynwhhgavqyennrftvprgvggkgdsgrpildnkgrvva
ivlggvnegsrtalsvvtwnqkgvtvkdtpegsepwslatvmcvlanitfpcdqppcmpccyeknphetltmleq
nydsraydqlldaavkcnarrtrrdldthftqyklarpyiadcpncghsrcdspiaieevrgdahagviriqtsa
mfglktdgvdlaymsfmngktqksikidnlhvrtsapcslvshhgyyilaqcppgdtvtvgfhdgpnrhtctvah
kvefrpvgrekyrhppehgvelpcnrythkradqghyvemhqpglvadhsllsihsakvkitvpsgaqvkyyckc
pdvrkgitssdhtttctdvkqcraylidnkkwvynsgrlprgegdtfkgklhvpfvpvkakciatlapeplvehk
hrtlilhlhpdhptllttrslgsdanptrqwierpttvnftvtgegleytwgnhppkrvwaqesgegnphgwphe
vvvyyynrypltiiglctcvaiimvscvtsvwllcrtrnlcitpyklapnaqvpillallccikptraddtlqv
lnylwnnnqnffwmqtliplaalivcmrmlrclfccgpafllvcgalgaaayehtavmpnkvgipykalverpgy
apvhlqiqlvntriipstnleyitckyktkvpspvvkccgatqctskphpdyqcqvfsgvypfmwggaycfcdte
ntqmseayverseecsidhakaykvhtgtvqamvnitygsvswrsadvyvngetpakigdakliigplssawspf
dnkvvvyghevynydfpeygtgkagsfgdlqsrtstsndlyantnlklqrpqagivhtpftqvpsgferwkkdkg
aplndvapfgcsialeplraencavgsipisidipdaaftrisetptvsdleckitectyafdfggiatvaykss
kagncpihspsgvavikendvtlaesgsftfhfstanihpafklqvctsavtckgdckppkdhivdypaqhtesf
tsaisatawswikvlvggtsafivlgliatavvalvlffhrh Figure 48A
CMV/R EEEV PE-6 strain capsid K67N E2 R239N VLP

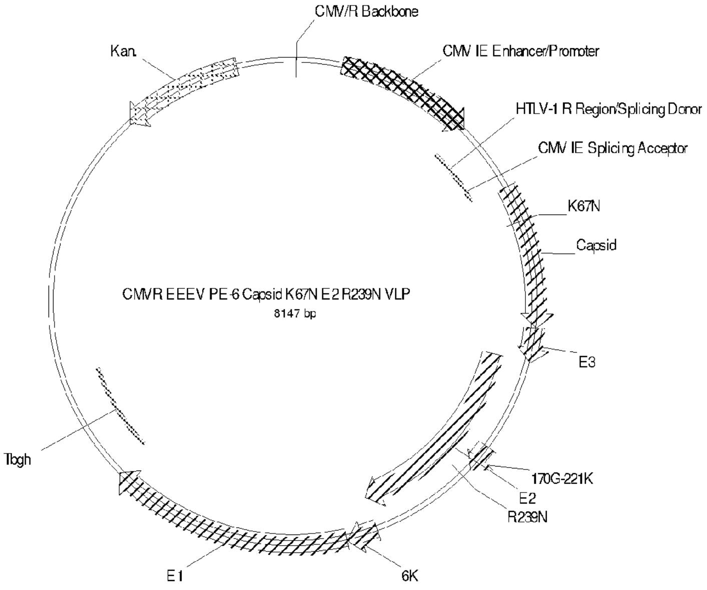

Figure 48B
Capsid sequence atgttcccataccctacacttaactacccgcctatggcgccgatcaacccgatggcttaccgggatcctaatccg
cctaggcgcaggtggcggccctttaggccaccacttgcagctcaaattgaggacctgagacgttccattgctagc
ctgactttgaaacaacgagcacctaatcctccagcaggaccgcccgccaatcgcaagaagcctgcgcccaagcct
aagcctgcgcaggcgaaaaagaaacgaccaccaccacctgccaagaaacaaaaacgtaaacctaaaccaggcaaa
cgacagcgaatgtgtatgaagctagagtcagataaaacgtttccgatcatgttgaacggacaggtgaatggttac
gcgtgcgtcgtgggtggacgagtgtttaaaccgctgcacgtagaaggcagaatagacaatgagcaactggccgcc
atcaagctgaagaaggccagcatatatgaccttgagtacggtgatgtgccacaatgcatgaaatcagataccctc
cagtacaccagtgacaagcctcctggcttttataactggcatcatggagctgtacagtatgagaacaataggttc
accgtaccacgaggggtcggtggaaagggtgacagcgggagacctattcttgacaacaaaggtagagtcgtcgca
attgtcctgggtggagtcaacgaaggatccaggacggctctatcagtggtgacatggaaccaaaaaggggttaca
gtcaaagatacaccagaggggtcagagccatgg Figure 48C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg

Figure 48C continued ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgccaccatgttcccataccctacacttaactacccgcctatggcgccgatcaac
ccgatggcttaccgggatcctaatccgcctaggcgcaggtggcggccctttaggccaccacttgcagctcaaatt
gaggacctgagacgttccattgctagcctgactttgaaacaacgagcacctaatcctccagcaggaccgcccgcc
aatcgcaagaagcctgcgcccaagcctaagcctgcgcaggcgaaaaagaaacgaccaccaccacctgccaagaaa
caaaaacgtaaacctaaaccaggcaaacgacagcgaatgtgtatgaagctagagtcagataaaacgtttccgatc
atgttgaacggacaggtgaatggttacgcgtgcgtcgtgggtggacgagtgtttaaaccgctgcacgtagaaggc
agaatagacaatgagcaactggccgccatcaagctgaagaaggccagcatatatgaccttgagtacggtgatgtg
ccacaatgcatgaaatcagataccctccagtacaccagtgacaagcctcctggcttttataactggcatcatgga
gctgtacagtatgagaacaataggttcaccgtaccacgaggggtcggtggaaagggtgacagcgggagacctatt
cttgacaacaaaggtagagtcgtcgcaattgtcctgggtggagtcaacgaaggatccaggacggctctatcagtg
gtgacatggaaccaaaaaggggttacagtcaaagatacaccagaggggtcagagccatggtcgcttgccactgtc
atgtgcgtcctggccaatatcacgtttccatgtgatcaaccaccctgcatgccatgctgttatgaaaagaatcca
cacgaaacactcaccatgttggaacagaattacgacagccgagcctatgatcagctgctcgatgccgctgtgaaa
tgtaatgctaggagaaccaggagagatttggacactcatttcacccagtataagctggcacgcccgtatattgct
gattgccctaactgtgggcatagtcggtgcgacagccctatagctatagaagaagtcagaggggatgcgcatgca
ggagtcatccgcatccagacatcagctatgttcggtctgaagacggatggagtcgatttggcctacatgagtttc
atgaacggcaaaacgcagaaatcaataaagatcgacaacctgcatgtgcgcacctcagccccttgttccctcgtg
tcgcaccacggctattacatcctggctcaatgcccaccaggagacacggttacagttgggtttcacgacgggcct
aaccgccatacgtgcacagttgcccataaggtagaattcaggccagtgggtagagagaaataccgtcacccacca
gaacatggagttgaattaccatgcaaccgttacactcacaagcgtgcagaccaaggacactacgttgagatgcat
caacccgggctagttgccgaccactctctccttagcatccacagtgccaaggtgaaaattacggtaccgagcggc
gcccaggtgaaatactactgcaagtgcccagatgtacgaaagggaattaccagcagcgaccatacaaccacctgc
acggatgtcaaacaatgcagggcttacctgattgacaacaaaaatgggtgtacaactctggaaatctgcctcga
ggagagggcgacactttaaaggaaaacttcatgtgccctttgtgcctgttaaggccaagtgcatcgccacgctg
gcaccagagcctctagttgagcacaaacaccgcaccctgattttacacctgcacccggaccatccgaccttgctg
acgaccaggtcacttggaagtgatgcaaatccaactcgacaatggattgagcgaccaacaactgtcaatttcaca
gtcaccggagaagggttggagtatacctggggaaaccatccaccaaaaagagtatgggctcaagagtcaggagaa
gggaatccacacggatggccgcacgaagtggtagtctattactacaacagatacccattaaccacaattatcggg
ttatgcacctgtgtggctatcatcatggtctcttgtgtcacatccgtgtggctcctttgcagaactcgcaatctt
tgcataaccccgtataaactagccccgaacgctcaagtcccaatactcctggcgttactttgctgcattaagccg
acgagggcagatgacaccttgcaagtgctgaattacctgtggaacaacaatcaaaactttttctggatgcagacg
cttatcccacttgcagcgcttatcgtatgcatgcgcatgctgcgctgcttattttgctgtgggccggcttttta
cttgtctgcggcgccttgggcgccgcagcgtacgaacacacagcagtgatgccgaacaaggtggggatcccgtat
aaagctttagtcgaacgcccaggttacgcacccgttcacctacagatacagctggttaataccaggataattcca
tcaactaacctggagtacatcacctgcaagtataagacaaaagtgccttctccagtagtgaaatgctgcggtgcc
actcaatgtacctccaaaccccatcctgactatcagtgtcaggtgttttcaggtgtttacccattcatgtggga
ggagcctactgcttctgcgacactgaaaacacccagatgagcgaggcgtatgtagagcgctcggaagagtgctct
attgaccacgcaaaagcttataaagtacacacaggcactgttcaggcaatggtaaacataacttatggagcgtc
agctggagatctgcagatgtttacgtcaatggtgaaactcccgcgaaaataggagatgccaaactcatcataggt
ccactgtcatcagcgtggtccccattcgataacaaggtggtggtttatggcatgaagtgtataattacgacttt
cctgagtacggcaccggcaaagcaggctcttttggagacctgcaatcacgcacatcaaccagcaacgatctgtac
gcaaacaccaacttgaagctacaacgaccccaggctggtatcgtgcacacacctttcacccaggtgccctctggc
ttcgaacgatggaaaaaggacaaaggggcaccgttgaacgacgtagccccgtttggctgttcgattgccctggag
ccgctccgtgcagaaaattgtgcagtgggaagcatccctatatctatagatatacccgatgcggctttcaccaga
atatctgaaacaccgacagtctcagacctggaatgcaaaattacggagtgtacttatgccttcgatttcggtggt
atagccaccgttgcctacaaatccagtaaagcaggaaactgtccaattcattctccatcaggtgttgcagttatt
aaagagaatgacgtcacgcttgctgagagcggatcatttacattccacttctccactgcaaacatccatcctgct
tttaagctgcaggtctgcactagtgcagttacctgcaaaggagattgtaagccaccgaaagaccacatcgtcgat
tatccagcacaacatactgaatcctttacgtcggcgatatccgccaccgcgtggtcgtggataaaagtgctggta
ggaggaacatcagcatttatcgttctggggcttattgctacagcagtggttgccctagttctgttcttccataga
cattaatctagaccaggccctggatccagatctgctgtgccttctagttgccagccatctgttgtttgcccctcc
cccgtgccttccttgaccctggaaggtgccactcccactgtcctttcctaataaaatgaggaaattgcatcgcat
tgtctgagtaggtgtcattctattctggggggtggggtggggcaggacagcaagggggaggattgggaagacaat
agcaggcatgctggggatgcggtgggctctatgggtacccaggtgctgaagaattgacccggttcctcctgggcc
agaaagaagcaggcacatcccctctctgtgacacaccctgtccacgcccctggttcttagttccagccccactc
ataggacactcatagctcaggagggctccgccttcaatcccacccgctaaagtacttggagcggtctctccctcc
ctcatcagcccaccaaaccaaacctagcctccaagagtgggaagaaattaaagcaagataggctattaagtgcag

Figure 48C continued agggagagaaaatgcctccaacatgtgaggaagtaatgagagaaatcatagaattttaaggccatgatttaaggc
catcatggccttaatcttccgcttcctcgctcactgactcgctgcgctcggtcgttcggctgcggcgagcggtat
cagctcactcaaaggcggtaatacggttatccacagaatcaggggataacgcaggaaagaacatgtgagcaaaag
gccagcaaaaggccaggaaccgtaaaaaggccgcgttgctggcgtttttccataggctccgcccccctgacgagc
atcacaaaaatcgacgctcaagtcagaggtggcgaaacccgacaggactataaagataccaggcgtttccccctg
gaagctccctcgtgcgctctcctgttccgaccctgccgcttaccggatacctgtccgcctttctcccttcgggaa
gcgtggcgctttctcatagctcacgctgtaggtatctcagttcggtgtaggtcgttcgctccaagctgggctgtg
tgcacgaaccccccgttcagcccgaccgctgcgccttatccggtaactatcgtcttgagtccaacccggtaagac
acgacttatcgccactggcagcagccactggtaacaggattagcagagcgaggtatgtaggcggtgctacagagt
tcttgaagtggtggcctaactacggctacactagaagaacagtatttggtatctgcgctctgctgaagccagtta
ccttcggaaaaagagttggtagctcttgatccggcaaacaaaccaccgctggtagcggtggtttttttgtttgca
agcagcagattacgcgcagaaaaaaaggatctcaagaagatcctttgatcttttctacggggtctgacgctcagt
ggaacgaaaactcacgttaagggattttggtcatgagattatcaaaaaggatcttcacctagatccttttaaatt
aaaaatgaagttttaaatcaatctaaagtatatatgagtaaacttggtctgacagttaccaatgcttaatcagtg
aggcacctatctcagcgatctgtctatttcgttcatccatagttgcctgactcggggggggggggcgctgaggtc
tgcctcgtgaagaaggtgttgctgactcataccaggcctgaatcgccccatcatccagccagaaagtgagggagc
cacggttgatgagagctttgttgtaggtggaccagttggtgattttgaacttttgctttgccacggaacggtctg
cgttgtcgggaagatgcgtgatctgatccttcaactcagcaaaagttcgatttattcaacaaagccgccgtcccg
tcaagtcagcgtaatgctctgccagtgttacaaccaattaaccaattctgattagaaaaactcatcgagcatcaa
atgaaactgcaatttattcatatcaggattatcaataccatatttttgaaaaagccgtttctgtaatgaaggaga
aaactcaccgaggcagttccataggatggcaagatcctggtatcggtctgcgattccgactcgtccaacatcaat
acaacctattaatttcccctcgtcaaaaataaggttatcaagtgagaaatcaccatgagtgacgactgaatccgg
tgagaatggcaaaagcttatgcatttctttccagacttgttcaacaggccagccattacgctcgtcatcaaaatc
actcgcatcaaccaaaccgttattcattcgtgattgcgcctgagcgagacgaaatacgcgatcgctgttaaaagg
acaattacaaacaggaatcgaatgcaaccggcgcaggaacactgccagcgcatcaacaatattttcacctgaatc
aggatattcttctaatacctggaatgctgttttcccggggatcgcagtggtgagtaaccatgcatcatcaggagt
acggataaaatgcttgatggtcggaagaggcataaattccgtcagccagtttagtctgaccatctcatctgtaac
atcattggcaacgctacctttgccatgtttcagaaacaactctggcgcatcgggcttcccatacaatcgatagat
tgtcgcacctgattgcccgacattatcgcgagcccatttatacccatataaatcagcatccatgttggaatttaa
tcgcggcctcgagcaagacgtttcccgttgaatatggctcataacaccccttgtattactgtttatgtaagcaga
cagttttattgttcatgatgatatatttttatcttgtgcaatgtaacatcagagattttgagacacaacgtggct
ttcccccccccccccattattgaagcatttatcagggttattgtctcatgagcggatacatatttgaatgtattta
gaaaaataaacaaataggggttccgcgcacatttccccgaaaagtgccacctgacgtctaagaaaccattattat
catgacattaacctataaaaataggcgtatcacgaggccctttcgtc Figure 48D
Capsid AA sequence mfpyptlnyppmapinpmayrdpnpprrrwrpfrpplaaqiedlrrsiasltlkqrapnppagppanrkkpapkp
kpaqakkkrppppakkqkrkpkpgkrqrmcmklesdktfpimlngqvngyacvvggrvfkplhvegridneqlaa
iklkkasiydleygdvpqcmksdtlqytsdkppgfynwhhgavqyennrftvprgvggkgdsgrpildnkgrvva
ivlggvnegsrtalsvvtwnqkgvtvkdtpegsepwslatvmcvlanitfpcdqppcmpccyeknphetltmleq
nydsraydqlldaavkcnarrtrrdldthftqyklarpyiadcpncghsrcdspiaieevrgdahagviriqtsa
mfglktdgvdlaymsfmngktqksikidnlhvrtsapcslvshhgyyilaqcppgdtvtvgfhdgpnrhtctvah
kvefrpvgrekyrhppehgvelpcnrythkradqghyvemhqpglvadhsllsihsakvkitvpsgaqvkyyckc
pdvrkgitssdhtttctdvkqcraylidnkkwvynsgnlprgegdtfkgklhvpfvpvkakciatlapeplvehk
hrtlilhlhpdhptllttrslgsdanptrqwierpttvnftvtgegleytwgnhppkrvwaqesgegnphgwphe
vvvyyynrypltiiglctcvaiimvscvtsvwllcrtrnlcitpyklapnaqvpillallccikptraddtlqv
lnylwnnnqnffwmqtliplaalivcmrmlrclfccgpafllvcgalgaaayehtavmpnkvgipykalverpgy
apvhlqiqlvntriipstnleyitckyktkvpspvvkccgatqctskphpdyqcqvfsgvypfmwggaycfcdte
ntqmseayverseecsidhakaykvhtgtvqamvnitygsvswrsadvyvngetpakigdakliigplssawspf
dnkvvvyghevynydfpeygtgkagsfgdlqsrtstsndlyantnlklqrpqagivhtpftqvpsgferwkkdkg
aplndvapfgcsialeplraencavgsipisidipdaaftrisetptvsdleckitectyafdfggiatvaykss
kagncpihspsgvavikendvtlaesgsftfhfstanihpafklqvctsavtckgdckppkdhivdypaqhtesf
tsaisatawswikvlvggtsafivlgliatavvalvlffhrh*

Figure 49A

CMV/R CHIKV(Strain 37997) Capsid R62A

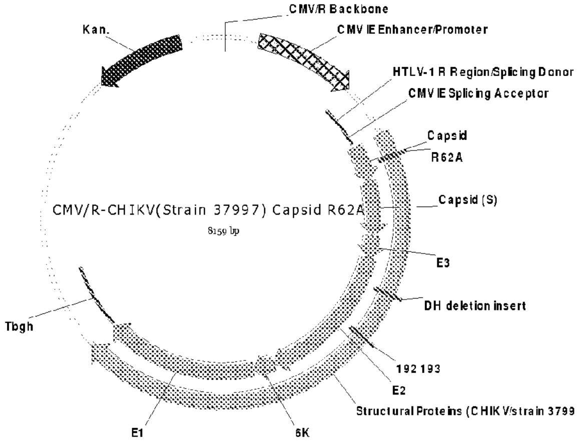

Figure 49B
Insert sequence atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctgccagaaatcggaaaaacaagaagcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtgggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggagggccaacgaaggtgcccgcacggccctctccgtggtgacgtggaacaaagacatcgtc
acaaaaattacccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
tattacgaggctgcggcatatctatggaacgaacagcagcccctgttctggttgcaggctcttatcccgctggcc
gccttgatcgtcctgtgcaactgtctgaaactcttgccatgctgctgtaagaccctggctttttagccgtaatg
agcatcggtgcccacactgtgagcgcgtacgaacacgtaacagtgatcccgaacacggtgggagtaccgtataag
actcttgtcaacagaccgggttacagccccatggtgttggagatggagctacaatcagtcaccttggaaccaaca
ctgtcacttgactacatcacgtgcgagtacaaaactgtcatcccctccccgtacgtgaagtgctgtggtacagca
gagtgcaaggacaagagcctaccagactacagctgcaaggtctttactggagtctacccatttatgtggggcggc

Figure 49B continued gcctactgcttttgcgacgccgaaaatacgcaattgagcgaggcacatgtagagaaatctgaatcttgcaaaaca
gagtttgcatcggcctacagagcccacaccgcatcggcgtcggcgaagctccgcgtcctttaccaaggaaacaac
attaccgtagctgcctacgctaacggtgaccatgccgtcacagtaaaggacgccaagtttgtcgtgggcccaatg
tcctccgcctggacaccttttgacaacaaaatcgtggtgtacaaaggcgacgtctacaacatggactacccacct
tttggcgcaggaagaccaggacaatttggtgacattcaaagtcgtacaccggaaagtaaagacgtttatgccaac
actcagttggtactacagaggccagcagcaggcacggtacatgtaccatactctcaggcaccatctggcttcaag
tattggctgaaggaacgaggagcatcgctacagcacacggcaccgttcggttgccagattgcgacaaacccggta
agagctgtaaattgcgctgtggggaacataccaatttccatcgacataccggatgcggcctttactagggttgtc
gatgcaccctctgtaacggacatgtcatgcgaagtaccagcctgcactcactcctccgactttgggggcgtcgcc
atcatcaaatacacagctagcaagaaaggtaaatgtgcagtacattcgatgaccaacgccgttaccattcgagaa
gccgacgtagaagtagaggggaactcccagctgcaaatatccttctcaacagccctggcaagcgccgagtttcgc
gtgcaagtgtgctccacacaagtacactgcgcagccgcatgccaccctccaaaggaccacatagtcaattaccca
gcatcacacaccacccttggggtccaggatatatccacaacggcaatgtcttgggtgcagaagattacgggagga
gtaggattaattgttgctgttgctgccttaattttaattgtggtgctatgcgtgtcgtttagcaggcactaa Figure 49C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctggccccacgccctacaattcaagtaattagacctagaccacgtccacagaggcaggctggg
caactcgcccagctgatctccgcagtcaacaaattgaccatgcgcgcggtacctcaacagaagcctgccagaaat
cggaaaaacaagaagcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgagggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcggcataaagacagatgacagccacgattgg
accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgaggactgacaaccacagac
aaagtgatcaataactgcaaaattgatcagtgccatgctgcagtcactaatcacaagaattggcaatacaactcc

Figure 49C continued cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactcttgtcaacagaccgggttacagccccatggtgttggag
atggagctacaatcagtcaccttggaaccaacactgtcacttgactacatcacgtgcgagtacaaaactgtcatc
cctccccgtacgtgaagtgctgtggtacagcagagtgcaaggacaagagcctaccagactacagctgcaaggtc
tttactggagtctacccatttatgtggggcggcgcctactgcttttgcgacgccgaaaatacgcaattgagcgag
gcacatgtagagaaatctgaatcttgcaaaacagagtttgcatcggcctacagagcccacaccgcatcggcgtcg
gcgaagctccgcgtcctttaccaaggaaacaacattaccgtagctgcctacgctaacggtgaccatgccgtcaca
gtaaaggacgccaagtttgtcgtgggcccaatgtcctccgcctggacaccttttgacaacaaaatcgtggtgtac
aaaggcgacgtctacaacatggactacccaccttttggcgcaggaagaccaggacaatttggtgacattcaaagt
cgtacaccggaaagtaaagacgtttatgccaacactcagttggtactacagaggccagcagcaggcacggtacat
gtaccatactctcaggcaccatctggcttcaagtattggctgaaggaacgaggagcatcgctacagcacacggca
ccgttcggttgccagattgcgacaaacccggtaagagctgtaaattgcgctgtggggaacataccaatttccatc
gacataccggatgcggcctttactagggttgtcgatgcaccctctgtaacggacatgtcatgcgaagtaccagcc
tgcactcactcctccgactttgggggcgtcgccatcatcaaatacacagctagcaagaaaggtaaatgtgcagta
cattcgatgaccaacgccgttaccattcgagaagccgacgtagaagtagaggggaactcccagctgcaaatatcc
ttctcaacagccctggcaagcgccgagtttcgcgtgcaagtgtgctccacacaagtacactgcgcagccgcatgc
caccctccaaaggaccacatagtcaattacccagcatcacacaccacccttggggtccaggatatatccacaacg
gcaatgtcttgggtgcagaagattacgggaggagtaggattaattgttgctgttgctgccttaattttaattgtg
gtgctatgcgtgtcgtttagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaatttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcgggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat

Figure 49C continued ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 49D

Amino acid sequence mefiptqtfynrryqprpwaprptiqvirprprpqrqagqlaqlisavnkltmravpqqkparnrknkkqrqkkq
apqndpkqkkqppqkkpaqkkkkpgrrermcmkiendcifevkhegkvmgyaclvgdkvmkpahvkgtidnadla
klafkrsskydlecaqipvhmksdaskfthekpegyynwhhgavqysggrftiptgagkpgdsgrpifdnkgrvv
aivlgganegartalsvvtwnkdivtkitpegaeewslalpvlcllanttfpcsqppctpccyekepestlrmle
dnvmrpgyyqllkasltcsphrqrrstkdnfnvykatrpylahcpdcgeghschspialerirneatdgtlkiqv
slqigiktddshdwtklrymdshtpadaeragllvrtsapctitgtmghfilarcpkgetltvgftdsrkishtc
thpfhheppvigrerfhsrpqhgkelpcstyvqstaataeeievhmppdtpdrtlmtqqsgnvkitvngqtvryk
cncggsnegltttdkvinnckidqchaavtnhknwqynsplvprnaelgdrkgkihipfplanvtcrvpkarnpt
vtygknqvtmllypdhptllsyrnmgqepnyheewvthkkevtltvpteglevtwgnnepykywpqmstngtahg
hpheiilyyyelyptmtvvivsvasfvllsmvgtavgmcvcarrrcitpyeltpgatvpfllsllccvrttkaat
yyeaaaylwneqqplfwlqaliplaalivlcnclkllpccckt laflavmsigahtvsayehvtvipntvgvpyk
tlvnrpgyspmvlemelqsvtleptlsldyitceyktvipspyvkccgtaeckdkslpdysckvftgvypfmwgg
aycfcdaentqlseahveksesckt efasayrahtasasaklrvlyqgnnitvaayangdhavtvkdakfvvgpm
ssawtpfdnkivvykgdvynmdyppfgagrpgqfgdiqsrtpeskdvyantqlvlqrpaagtvhvpysqapsgfk
ywlkergaslqhtapfgcqiatnpvravncavgnipisidipdaaftrvvdapsvtdmscevpacthssdfggva
iikytaskkgkcavhsmtnavtireadvevegnsqlqisfstalasaefrvqvcstqvhcaaachppkdhivnyp
ashttlgvqdisttamswvqkitggvglivavaalilivvlcvsfsrh

Figure 50A

CMV/R CHIKV(Strain 37997) Capsid R62A R63A

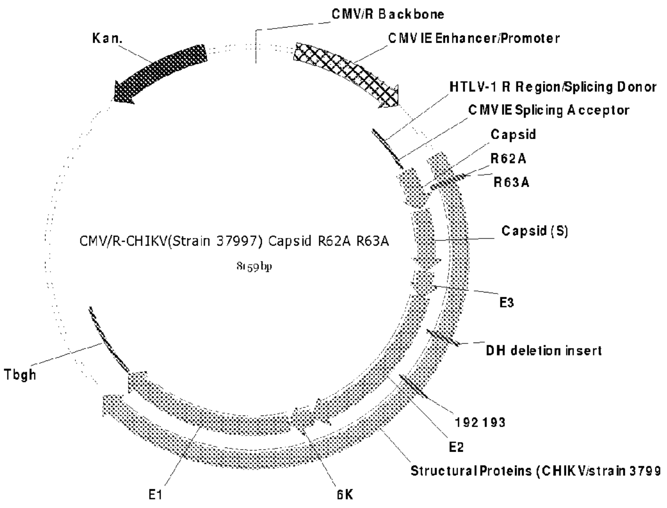

Figure 50B

Insert sequence atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctgccgcaaatcggaaaaacaagaagcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtgggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggaggggccaacgaaggtgcccgcacggccctctccgtggtgacgtggaacaaagacatcgtc
acaaaaattacccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
tattacgaggctgcggcatatctatggaacgaacagcagcccctgttctggttgcaggctcttatcccgctggcc
gccttgatcgtcctgtgcaactgtctgaaactcttgccatgctgctgtaagaccctggctttttagccgtaatg

Figure 50B continued agcatcggtgcccacactgtgagcgcgtacgaacacgtaacagtgatcccgaacacggtgggagtaccgtataag
actcttgtcaacagaccgggttacagccccatggtgttggagatggagctacaatcagtcaccttggaaccaaca
ctgtcacttgactacatcacgtgcgagtacaaaactgtcatcccctccccgtacgtgaagtgctgtggtacagca
gagtgcaaggacaagagcctaccagactacagctgcaaggtctttactggagtctacccatttatgtggggcggc
gcctactgcttttgcgacgccgaaaatacgcaattgagcgaggcacatgtagagaaatctgaatcttgcaaaaca
gagtttgcatcggcctacagagcccacaccgcatcggcgtcggcgaagctccgcgtcctttaccaaggaaacaac
attaccgtagctgcctacgctaacggtgaccatgccgtcacagtaaaggacgccaagtttgtcgtgggcccaatg
tcctccgcctggacaccttttgacaacaaaatcgtggtgtacaaaggcgacgtctacaacatggactacccacct
tttggcgcaggaagaccaggacaatttggtgacattcaaagtcgtacaccggaaagtaaagacgtttatgccaac
actcagttggtactacagaggccagcagcaggcacggtacatgtaccatactctcaggcaccatctggcttcaag
tattggctgaaggaacgaggagcatcgctacagcacacggcaccgttcggttgccagattgcgacaaacccggta
agagctgtaaattgcgctgtggggaacataccaatttccatcgacataccggatgcggcctttactagggttgtc
gatgcaccctctgtaacggacatgtcatgcgaagtaccagcctgcactcactcctccgactttggggcgtcgcc
atcatcaaatacacagctagcaagaaaggtaaatgtgcagtacattcgatgaccaacgccgttaccattcgagaa
gccgacgtagaagtagaggggaactcccagctgcaaatatccttctcaacagccctggcaagcgccgagtttcgc
gtgcaagtgtgctccacacaagtacactgcgcagccgcatgccaccctccaaaggaccacatagtcaattaccca
gcatcacacaccacccttggggtccaggatatatccacaacggcaatgtcttgggtgcagaagattacgggagga
gtaggattaattgttgctgttgctgccttaattttaattgtggtgctatgcgtgtcgtttagcaggcactaa Figure 50C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctgggccccacgccctacaattcaagtaattagacctagaccacgtccacagaggcaggctggg
caactcgcccagctgatctccgcagtcaacaattgaccatgcgcgcggtacctcaacagaagcctgccgcaaat
cggaaaaacaagaagcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgagggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccgggaccatgggacactttattctcgcccgatgcccgaaaggagagacgctgacagtggga
tttacggacagcagaaagatcagccacacatgcacacacccgttccatcatgaaccacctgtgataggtagggag

Figure 50C continued aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactcttgtcaacagaccgggttacagccccatggtgttggag
atggagctacaatcagtcaccttggaaccaacactgtcacttgactacatcacgtgcgagtacaaaactgtcatc
ccctccccgtacgtgaagtgctgtggtacagcagagtgcaaggacaagagcctaccagactacagctgcaaggtc
tttactggagtctacccatttatgtggggcggcgcctactgcttttgcgacgccgaaaatacgcaattgagcgag
gcacatgtagagaaatctgaatcttgcaaaacagagtttgcatcggcctacagagcccacaccgcatcggcgtcg
gcgaagctccgcgtcctttaccaaggaaacaacattaccgtagctgcctacgctaacggtgaccatgccgtcaca
gtaaaggacgccaagtttgtcgtgggcccaatgtcctccgcctggacaccttttgacaacaaaatcgtggtgtac
aaaggcgacgtctacaacatggactacccacctttggcgcaggaagaccaggacaatttggtgacattcaaagt
cgtacaccggaaagtaaagacgtttatgccaacactcagttggtactacagaggccagcagcaggcacggtacat
gtaccatactctcaggcaccatctggcttcaagtattggctgaaggaacgaggagcatcgctacagcacacggca
ccgttcggttgccagattgcgacaaacccggtaagagctgtaaattgcgctgtggggaacataccaatttccatc
gacataccggatgcggcctttactaggcttgtcgatgcaccctctgtaacggacatgtcatgcgaagtaccagcc
tgcactcactcctccgactttgggggcgtcgccatcatcaaatacacagctagcaagaaaggtaaatgtgcagta
cattcgatgaccaacgccgttaccattcgagaagccgacgtagaagtagaggggaactcccagctgcaaatatcc
ttctcaacagccctggcaagcgccgagtttcgcgtgcaagtgtgctccacacaagtacactgcgcagccgcatgc
caccctccaaaggaccacatagtcaattacccagcatcacacaccacccttggggtccaggatatatccacaacg
gcaatgtcttgggtgcagaagattacggaggagtaggattaattgttgctgttgctgccttaattttaattgtg
gtgctatgcgtgtcgtttagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagaggcagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc

Figure 50C continued gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 50D

Amino acid sequence mefiptqtfynrryqprpwaprptiqvirprprpqrqagqlaqlisavnkltmravpqqkpaanrknkkqrqkkq
apqndpkqkkqppqkkpaqkkkkpgrrermcmkiendcifevkhegkvmgyaclvgdkvmkpahvkgtidnadla
klafkrsskydlecaqipvhmksdaskfthekpegyynwhhgavqysggrftiptgagkpgdsgrpifdnkgrvv
aivlgganegartalsvvtwnkdivtkitpegaeewslalpvlcllanttfpcsqppctpccyekepestlrmle
dnvmrpgyyqllkasltcsphrqrrstkdnfnvykatrpylahcpdcgeghschspialerirneatdgtlkiqv
slqigiktddshdwtklrymdshtpadaeragllvrtsapctitgtmghfilarcpkgetltvgftdsrkishtc
thpfhheppvigrerfhsrpqhgkelpcstyvqstaataeeievhmppdtpdrtlmtqqsgnvkitvngqtvryk
cncggsnegltttdkvinnckidqchaavtnhknwqynsplvprnaelgdrkgkihipfplanvtcrvpkarnpt
vtygknqvtmllypdhptllsyrnmgqepnyheewvthkkevtltvpteglevtwgnnepykywpqmstngtahg
hpheiilyyyelyptmtvvivsvasfvllsmvgtavgmcvcarrrcitpyeltpgatvpfllsllccvrttkaat
yyeaaaylwneqqplfwlqaliplaalivlcnclkllpccktlaflavmsigahtvsayehvtvipntvgvpyk
tlvnrpgyspmvlemelqsvtleptlsldyitceyktvipspyvkccgtaeckdkslpdysckvftgvypfmwgg
aycfcdaentqlseahveksescktefasayrahtasasaklrvlyqgnnitvaayangdhavtvkdakfvvgpm
ssawtpfdnkivvykgdvynmdyppfgagrpgqfgdiqsrtpeskdvyantqlvlqrpaagtvhvpysqapsgfk
ywlkergaslqhtapfgcqiatnpvravncavgnipisidipdaaftrvvdapsvtdmscevpacthssdfggva
iikytaskkgkcavhsmtnavtireadvevegnsqlqisfstalasaefrvqvcstqvhcaaachppkdhivnyp
ashttlgvqdisttamswvqkitggvglivavaalilivvlcvsfsrh

Figure 51A

CMV/R CHIKV(Strain 37997) Capsid R62A R63A R65A K66A K68A K69A

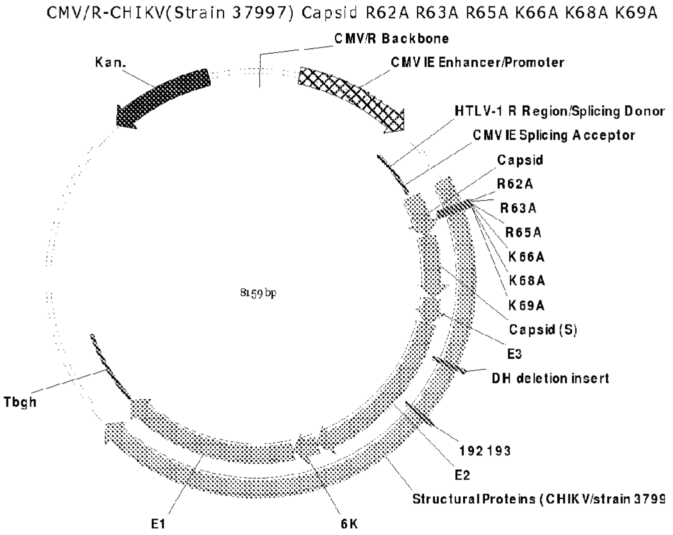

Figure 51B
Insert sequence atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctgccgcaaatgcggcaaacgcggcgcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtgggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggaggggccaacgaaggtgcccgcacggccctctccgtggtgacgtggaacaaagacatcgtc
acaaaaattacccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg
ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
tattacgaggctgcggcatatctatggaacgaacagcagcccctgttctggttgcaggctcttatcccgctggcc

Figure 51B continued gccttgatcgtcctgtgcaactgtctgaaactcttgccatgctgctgtaagaccctggctttttagccgtaatg
agcatcggtgcccacactgtgagcgcgtacgaacacgtaacagtgatcccgaacacggtgggagtaccgtataag
actcttgtcaacagaccgggttacagccccatggtgttggagatggagctacaatcagtcaccttggaaccaaca
ctgtcacttgactacatcacgtgcgagtacaaactgtcatcccctccccgtacgtgaagtgctgtggtacagca
gagtgcaaggacaagagcctaccagactacagctgcaaggtctttactggagtctacccatttatgtggggcggc
gcctactgcttttgcgacgccgaaaatacgcaattgagcgaggcacatgtagagaaatctgaatcttgcaaaaca
gagtttgcatcggcctacagagcccacaccgcatcggcgtcggcgaagctccgcgtcctttaccaaggaaacaac
attaccgtagctgcctacgctaacggtgaccatgccgtcacagtaaaggacgccaagtttgtcgtgggcccaatg
tcctccgcctggacaccttttgacaacaaaatcgtggtgtacaaaggcgacgtctacaacatggactacccacct
tttggcgcaggaagaccaggacaatttggtgacattcaaagtcgtacaccggaaagtaaagacgtttatgccaac
actcagttggtactacagaggccagcagcaggcacggtacatgtaccatactctcaggcaccatctggcttcaag
tattggctgaaggaacgaggagcatcgctacagcacacggcaccgttcggttgccagattgcgacaaacccggta
agagctgtaaattgcgctgtggggaacataccaatttccatcgacataccggatgcggcctttactagggttgtc
gatgcaccctctgtaacggacatgtcatgcgaagtaccagcctgcactcactcctccgactttgggggcgtcgcc
atcatcaaatacacagctagcaagaaaggtaaatgtgcagtacattcgatgaccaacgccgttaccattcgagaa
gccgacgtagaagtagaggggaactcccagctgcaaatatccttctcaacagccctggcaagcgccgagtttcgc
gtgcaagtgtgctccacacaagtacactgcgcagccgcatgccaccctccaaaggaccacatagtcaattaccca
gcatcacacaccacccttggggtccaggatatatccacaacggcaatgtcttgggtgcagaagattacggagga
gtaggattaattgttgctgttgctgccttaattttaattgtggtgctatgcgtgtcgtttagcaggcactaa

Figure 51C

Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctgggccccacgccctacaattcaagtaattagacctagaccacgtccacagaggcaggctggg
caactcgcccagctgatctccgcagtcaacaaattgaccatgcgcgcggtacctcaacagaagcctgccgcaaat
gcggcaaacgcggcgcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgagggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat
gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccgggaccatggacactttattctcgcccgatgcccgaaaggagagacgctgacagtggga

Figure 51C continued tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttggggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactcttgtcaacagaccgggttacagccccatggtgttggag
atggagctacaatcagtcaccttggaaccaacactgtcacttgactacatcacgtgcgagtacaaaactgtcatc
ccctccccgtacgtgaagtgctgtggtacagcagagtgcaaggacaagagcctaccagactacagctgcaaggtc
tttactggagtctacccatttatgtggggcggcgcctactgcttttgcgacgccgaaaatacgcaattgagcgag
gcacatgtagagaaatctgaatcttgcaaaacagagtttgcatcggcctacagagcccacaccgcatcggcgtcg
gcgaagctccgcgtcctttaccaaggaaacaacattaccgtagctgcctacgctaacggtgaccatgccgtcaca
gtaaaggacgccaagtttgtcgtgggcccaatgtcctccgcctggacacctttgacaacaaatcgtggtgtac
aaaggcgacgtctacaacatggactacccacctttggcgcaggaagaccaggacaatttggtgacattcaaagt
cgtacaccggaaagtaaagacgtttatgccaacactcagttggtactacagaggccagcagcaggcacggtacat
gtaccatactctcaggcaccatctggcttcaagtattggctgaaggaacgaggagcatcgctacagcacacggca
ccgttcggttgccagattgcgacaaacccggtaagagctgtaaattgcgctgtggggaacataccaatttccatc
gacataccggatgcggcctttactagggttgtcgatgcaccctctgtaacggacatgtcatgcgaagtaccagcc
tgcactcactcctccgactttgggggcgtcgccatcatcaaatacacagctagcaagaaaggtaaatgtgcagta
cattcgatgaccaacgccgttaccattcgagaagccgacgtagaagtagaggggaactcccagctgcaaatatcc
ttctcaacagccctggcaagcgccgagtttcgcgtgcaagtgtgctccacacaagtacactgcgcagccgcatgc
caccctccaaaggaccacatagtcaattacccagcatcacacaccacccttggggtccaggatatatccacaacg
gcaatgtcttgggtgcagaagattacgggaggagtaggattaattgttgctgttgctgccttaattttaattgtg
gtgctatgcgtgtcgtttagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaacttttgctttgcca
cggaacggtctgcgttgtcggcaagatgcgtgatctgatccttcaactcagcaaaagttcgatttattcaacaaa
gccgccgtcccgtcaagtcagcgtaatgctctgccagtgttacaaccaattaaccaattctgattagaaaactc
atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac

Figure 51C continued gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttcccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 51D

Amino Acid sequence mefiptqtfynrrycprpwaprptiqvirprprpqrqagqlaqlisavnkltmravpqqkpaanaanaaqrqkkq
apqndpkqkkqppqkkpaqkkkkpgrrermcmkiendcifevkhegkvmgyaclvgdkvmkpahvkgtidnadla
klafkrsskydlecaqipvhmksdaskfthekpegyynwhhgavqysggrftiptgagkpgdsgrpifdnkgrvv
aivlgganegartalsvvtwnkdivtkitpegaeewslalpvlcllanttfpcsqppctpccyekepestlrmle
dnvmrpgyyqllkasltcsphrqrrstkdnfnvykatrpylahcpdcgeghschspialerirneatdgtlkiqv
slqigiktddshdwtklrymdshtpadaeragllvrtsapctitgtmghfilarcpkgetltvgftdsrkishtc
thpfhheppvigrerfhsrpqhgkelpcstyvqstaataeeievhmppdtpdrtlmtqqsgnvkitvngqtvryk
cncggsnegltttdkvinnckidqchaavtnhknwqynsplvprnaelgdrkgkihipfplanvtcrvpkarnpt
vtygknqvtmllypdhptllsyrnmgqepnyheewvthkkevtltvpteglevtwgnnepykywpqmstngtahg
hpheiilyyyelyptmtvvivsvasfvllsmvgtavgmcvcarrrcitpyeltpgatvpfllsllccvrttkaat
yyeaaaylwneqqplfwlqaliplaalivlcnclkllpccck tlaflavmsigahtvsayehvtvipntvgvpyk
tlvnrpgyspmvlemelqsvtleptlsldyitceyktvipspyvkccgtaeckdkslpdysckvftgvypfmwgg
aycfcdaentqlseahveksesscktefasayrahtasasaklrvlyqgnnitvaayangdhavtvkdakfvvgpm
ssawtpfdnkivvykgdvynmdyppfgagrpgqfgdiqsrtpeskdvyantqlvlqrpaagtvhvpysqapsgfk
ywlkergaslqhtapfgcqiatnpvravncavgnipisidipdaaftrvvdapsvtdmscevpacthssdfggva
iikytaskkgkcavhsmtnavtireadvevegnsqlqisfstalasaefrvqvcstqvhcaaachppkdhivnyp
ashttlgvqdisttamswvqkitggvglivavaalilivvlcvsfsrh

Figure 52A

CMV/R CHIKV(Strain 37997) Capsid R65A

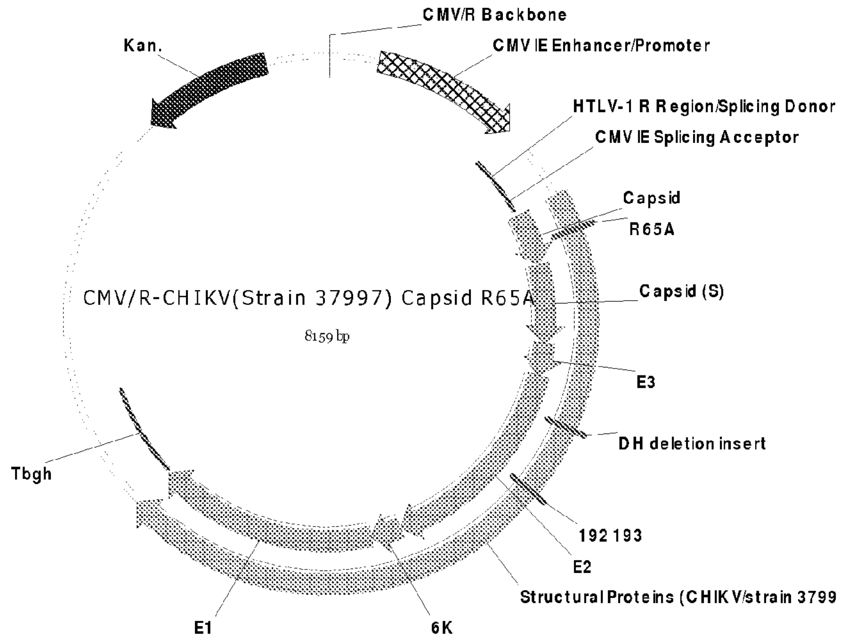

Figure 52B
Insert sequence atggagttcatcccgacgcaaactttctataacagaaggtaccaaccccgaccctgggccccacgccctacaatt
caagtaattagacctagaccacgtccacagaggcaggctgggcaactcgcccagctgatctccgcagtcaacaaa
ttgaccatgcgcgcggtacctcaacagaagcctcgcagaaatgcgaaaaacaagaagcaaaggcagaagaagcag
gcgccgcaaaacgacccaaagcaaaagaagcaaccaccacaaaagaagccggctcaaaagaagaagaaaccaggc
cgtagggagagaatgtgcatgaaaattgaaaatgattgcatcttcgaagtcaagcatgaaggcaaagtgatgggc
tacgcatgcctggtgggggataaagtaatgaaaccagcacatgtgaagggaactatcgacaatgccgatctggct
aaactggcctttaagcggtcgtctaaatacgatcttgaatgtgcacagataccggtgcacatgaagtctgatgcc
tcgaagtttacccacgagaaacccgaggggtactataactggcatcacggagcagtgcagtattcaggaggccgg
ttcactatcccgacgggtgcaggcaagccgggagacagcggcagaccgatcttcgacaacaaaggacgggtggtg
gccatcgtcctaggaggggccaacgaaggtgcccgcacggccctctccgtggtgacgtggaacaaagacatcgtc
acaaaaattacccctgagggagccgaagagtggagcctcgccctcccggtcttgtgcctgttggcaaacactaca
ttcccctgctctcagccgccttgcacaccctgctgctacgaaaaggaaccggaaagcaccttgcgcatgcttgag
gacaacgtgatgagacccggatactaccagctactaaaagcatcgctgacttgctctccccaccgccaaagacgc
agtactaaggacaattttaatgtctataaagccacaagaccatatctagctcattgtcctgactgcggagaaggg
cattcgtgccacagccctatcgcattggagcgcatcagaaatgaagcaacggacggaacgctgaaatccaggtc
tctttgcagatcgggataaagacagatgacagccacgattggaccaagctgcgctatatggatagccatacgcca
gcggacgcggagcgagccggattgcttgtaaggacttcagcaccgtgcacgatcaccgggaccatgggacacttt
attctcgcccgatgcccgaaaggagagacgctgacagtgggatttacggacagcagaaagatcagccacacatgc
acacacccgttccatcatgaaccacctgtgataggtagggagaggttccactctcgaccacaacatggtaaagag
ttaccttgcagcacgtacgtgcagagcaccgctgccactgctgaggagatagaggtgcatatgcccccagatact
cctgaccgcacgctgatgacgcagcagtctggcaacgtgaagatcacagttaatgggcagacggtgcggtacaag
tgcaactgcggtggctcaaacgagggactgacaaccacagacaaagtgatcaataactgcaaaattgatcagtgc
catgctgcagtcactaatcacaagaattggcaatacaactcccctttagtcccgcgcaacgctgaactcggggac
cgtaaaggaaagatccacatcccattcccattggcaaacgtgacttgcagagtgccaaaagcaagaaaccctaca
gtaacttacggaaaaaaccaagtcaccatgctgctgtatcctgaccatccgacactcttgtcttaccgtaacatg
ggacaggaaccaaattaccacgaggagtgggtgacacacaagaaggaggttaccttgaccgtgcctactgagggt
ctggaggtcacttggggcaacaacgaaccatacaagtactggccgcagatgtctacgaacggtactgctcatggt
cacccacatgagataatcttgtactattatgagctgtaccccactatgactgtagtcattgtgtcggtggcctcg

Figure 52B continued ttcgtgcttctgtcgatggtgggcacagcagtgggaatgtgtgtgtgcgcacggcgcagatgcattacaccatat
gaattaacaccaggagccactgttcccttcctgctcagcctgctatgctgcgtcagaacgaccaaggcggccaca
tattacgaggctgcggcatatctatggaacgaacagcagcccctgttctggttgcaggctcttatcccgctggcc
gccttgatcgtcctgtgcaactgtctgaaactcttgccatgctgctgtaagaccctggctttttttagccgtaatg
agcatcggtgcccacactgtgagcgcgtacgaacacgtaacagtgatcccgaacacggtgggagtaccgtataag
actcttgtcaacagaccgggttacagccccatggtgttggagatggagctacaatcagtcaccttggaaccaaca
ctgtcacttgactacatcacgtgcgagtacaaaactgtcatcccctccccgtacgtgaagtgctgtggtacagca
gagtgcaaggacaagagcctaccagactacagctgcaaggtctttactggagtctacccatttatgtggggcggc
gcctactgcttttgcgacgccgaaaatacgcaattgagcgaggcacatgtagagaaatctgaatcttgcaaaaca
gagtttgcatcggcctacagagcccacaccgcatcggcgtcggcgaagctccgcgtcctttaccaaggaaacaac
attaccgtagctgcctacgctaacggtgaccatgccgtcacagtaaaggacgccaagtttgtcgtgggcccaatg
tcctccgcctggacacctttgacaacaaaatcgtggtgtacaaaggcgacgtctacaacatggactacccacct
tttggcgcaggaagaccaggacaatttggtgacattcaaagtcgtacaccggaaagtaaagacgtttatgccaac
actcagttggtactacagaggccagcagcaggcacggtacatgtaccatactctcaggcaccatctggcttcaag
tattggctgaaggaacgaggagcatcgctacagcacacggcaccgttcggttgccagattgcgacaaacccggta
agagctgtaaattgcgctgtggggaacataccaatttccatcgacataccggatgcggcctttactagggttgtc
gatgcaccctctgtaacggacatgtcatgcgaagtaccagcctgcactcactcctccgactttggggggcgtcgcc
atcatcaaatacacagctagcaagaaaggtaaatgtgcagtacattcgatgaccaacgccgttaccattcgagaa
gccgacgtagaagtagaggggaactcccagctgcaaatatccttctcaacagccctggcaagcgccgagtttcgc
gtgcaagtgtgctccacacaagtacactgcgcagccgcatgccaccctccaaaggaccacatagtcaattaccca
gcatcacacaccaccccttggggtccaggatatatccacaacggcaatgtcttggtgcagaagattacggagga
gtaggattaattgttgctgttgctgccttaattttaattgtggtgctatgcgtgtcgtttagcaggcactaa Figure 52C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatggagttcatcccgacgcaaactttctataacagaaggtac
caaccccgaccctggccccacgccctacaattcaagtaattagacctagaccacgtccacagaggcaggctggg
caactcgcccagctgatctccgcagtcaacaaattgaccatgcgcgcggtacctcaacagaagcctcgcagaaat
gcgaaaaacaagaagcaaaggcagaagaagcaggcgccgcaaaacgacccaaagcaaaagaagcaaccaccacaa
aagaagccggctcaaaagaagaagaaaccaggccgtagggagagaatgtgcatgaaaattgaaaatgattgcatc
ttcgaagtcaagcatgaaggcaaagtgatgggctacgcatgcctggtgggggataaagtaatgaaaccagcacat
gtgaagggaactatcgacaatgccgatctggctaaactggcctttaagcggtcgtctaaatacgatcttgaatgt
gcacagataccggtgcacatgaagtctgatgcctcgaagtttacccacgagaaacccgaggggtactataactgg
catcacggagcagtgcagtattcaggaggccggttcactatcccgacgggtgcaggcaagccgggagacagcggc
agaccgatcttcgacaacaaaggacgggtggtggccatcgtcctaggaggggccaacgaaggtgcccgcacggcc
ctctccgtggtgacgtggaacaaagacatcgtcacaaaaattacccctgaggagccgaagagtggagcctcgcc
ctcccggtcttgtgcctgttggcaaacactacattcccctgctctcagccgccttgcacaccctgctgctacgaa
aaggaaccggaaagcaccttgcgcatgcttgaggacaacgtgatgagacccggatactaccagctactaaaagca
tcgctgacttgctctccccaccgccaaagacgcagtactaaggacaattttaatgtctataaagccacaagacca
tatctagctcattgtcctgactgcggagaagggcattcgtgccacagccctatcgcattggagcgcatcagaaat

Figure 52C continued gaagcaacggacggaacgctgaaaatccaggtctctttgcagatcgggataaagacagatgacagccacgattgg
accaagctgcgctatatggatagccatacgccagcggacgcggagcgagccggattgcttgtaaggacttcagca
ccgtgcacgatcaccggaccatgggacactttattctcgcccgatgcccgaaaggagagacgctgacagtggga
tttacggacagcagaaagatcagccacacatgcacacacccgttccatcatgaaccacctgtgataggtagggag
aggttccactctcgaccacaacatggtaaagagttaccttgcagcacgtacgtgcagagcaccgctgccactgct
gaggagatagaggtgcatatgcccccagatactcctgaccgcacgctgatgacgcagcagtctggcaacgtgaag
atcacagttaatgggcagacggtgcggtacaagtgcaactgcggtggctcaaacgagggactgacaaccacagac
aaagtgatcaataactgcaaaattgatcagtgccatgctgcagtcactaatcacaagaattggcaatacaactcc
cctttagtcccgcgcaacgctgaactcggggaccgtaaaggaaagatccacatcccattcccattggcaaacgtg
acttgcagagtgccaaaagcaagaaaccctacagtaacttacggaaaaaaccaagtcaccatgctgctgtatcct
gaccatccgacactcttgtcttaccgtaacatgggacaggaaccaaattaccacgaggagtgggtgacacacaag
aaggaggttaccttgaccgtgcctactgagggtctggaggtcacttgggcaacaacgaaccatacaagtactgg
ccgcagatgtctacgaacggtactgctcatggtcacccacatgagataatcttgtactattatgagctgtacccc
actatgactgtagtcattgtgtcggtggcctcgttcgtgcttctgtcgatggtgggcacagcagtgggaatgtgt
gtgtgcgcacggcgcagatgcattacaccatatgaattaacaccaggagccactgttcccttcctgctcagcctg
ctatgctgcgtcagaacgaccaaggcggccacatattacgaggctgcggcatatctatggaacgaacagcagccc
ctgttctggttgcaggctcttatcccgctggccgccttgatcgtcctgtgcaactgtctgaaactcttgccatgc
tgctgtaagaccctggctttttagccgtaatgagcatcggtgcccacactgtgagcgcgtacgaacacgtaaca
gtgatcccgaacacggtgggagtaccgtataagactcttgtcaacagaccgggttacagccccatggtgttggag
atggagctacaatcagtcaccttggaaccaacactgtcacttgactacatcacgtgcgagtacaaaactgtcatc
ccctccccgtacgtgaagtgctgtggtacagcagagtgcaaggacaagagcctaccagactacagctgcaaggtc
tttactggagtctacccatttatgtggggcggcgcctactgcttttgcgacgccgaaaatacgcaattgagcgag
gcacatgtagagaaatctgaatcttgcaaaacagagtttgcatcggcctacagagcccacaccgcatcggcgtcg
gcgaagctccgcgtcctttaccaaggaaacaacattaccgtagctgcctacgctaacggtgaccatgccgtcaca
gtaaaggacgccaagtttgtcgtgggcccaatgtcctccgcctggacaccttttgacaacaaaatcgtggtgtac
aaaggcgacgtctacaacatggactacccacctttggcgcaggaagaccaggacaatttggtgacattcaaagt
cgtacaccggaaagtaaagacgtttatgccaacactcagttggtactacagaggccagcagcaggcacggtacat
gtaccatactctcaggcaccatctggcttcaagtattggctgaaggaacgaggagcatcgctacagcacacggca
ccgttcggttgccagattgcgacaaacccggtaagagctgtaaattgcgctgtggggaacataccaatttccatc
gacataccggatgcggcctttactagggttgtcgatgcaccctctgtaacggacatgtcatgcgaagtaccagcc
tgcactcactcctccgactttggggcgtcgccatcatcaaatacacagctagcaagaaaggtaaatgtgcagta
cattcgatgaccaacgccgttaccattcgagaagccgacgtagaagtagaggggaactcccagctgcaaatatcc
ttctcaacagccctggcaagcgccgagtttcgcgtgcaagtgtgctccacacaagtacactgcgcagccgcatgc
caccctccaaaggaccacatagtcaattacccagcatcacacaccaccccttggggtccaggatatatccacaacg
gcaatgtcttgggtgcagaagattacgggaggagtaggattaattgttgctgttgctgccttaattttaattgtg
gtgctatgcgtgtcgtttagcaggcactaatgaggatccagatctgctgtgccttctagttgccagccatctgtt
gtttgcccctcccccgtgccttccttgaccctggaaggtgccactcccactgtcctttcctaataaaatgaggaa
attgcatcgcattgtctgagtaggtgtcattctattctggggggtggggtggggcaggacagcaagggggaggat
tgggaagacaatagcaggcatgctggggatgcggtgggctctatgggtacccaggtgctgaagaattgacccggt
tcctcctgggccagaaagaagcaggcacatccccttctctgtgacacaccctgtccacgcccctggttcttagtt
ccagccccactcataggacactcatagctcaggagggctccgccttcaatcccacccgctaaagtacttggagcg
gtctctccctccctcatcagcccaccaaaccaaacctagcctccaagagtgggaagaaattaaagcaagataggc
tattaagtgcagagggagagaaaatgcctccaacatgtgaggaagtaatgagagaaatcatagaattttaaggcc
atgatttaaggccatcatggccttaatcttccgcttcctcgctcactgactcgctgcgctcggtcgttcggctgc
ggcgagcggtatcagctcactcaaaggcggtaatacggttatccacagaatcaggggataacgcaggaaagaaca
tgtgagcaaaaggccagcaaaaggccaggaaccgtaaaaaggccgcgttgctggcgtttttccataggctccgcc
cccctgacgagcatcacaaaaatcgacgctcaagtcagaggtggcgaaacccgacaggactataaagataccagg
cgtttccccctggaagctccctcgtgcgctctcctgttccgaccctgccgcttaccggatacctgtccgcctttc
tcccttcgggaagcgtggcgctttctcatagctcacgctgtaggtatctcagttcggtgtaggtcgttcgctcca
agctgggctgtgtgcacgaaccccccgttcagcccgaccgctgcgccttatccggtaactatcgtcttgagtcca
acccggtaagacacgacttatcgccactggcagcagccactggtaacaggattagcagagcgaggtatgtaggcg
gtgctacagagttcttgaagtggtggcctaactacggctacactagaagaacagtatttggtatctgcgctctgc
tgaagccagttaccttcggaaaaagagttggtagctcttgatccggcaaacaaaccaccgctggtagcggtggtt
tttttgtttgcaagcagcagattacgcgcagaaaaaaaggatctcaagaagatcctttgatcttttctacggggt
ctgacgctcagtggaacgaaaactcacgttaagggattttggtcatgagattatcaaaaaggatcttcacctaga
tccttttaaattaaaaatgaagttttaaatcaatctaaagtatatatgagtaaacttggtctgacagttaccaat
gcttaatcagtgaggcacctatctcagcgatctgtctatttcgttcatccatagttgcctgactcggggggggg
ggcgctgaggtctgcctcgtgaagaaggtgttgctgactcataccaggcctgaatcgccccatcatccagccaga
aagtgagggagccacggttgatgagagctttgttgtaggtggaccagttggtgattttgaactttgctttgcca
cggaacggtctgcgttgtcgggaagatgcgtgatctgatccttcaactcagcaaaagttcgatttattcaacaaa
gccgccgtcccgtcaagtcagcgtaatgctctgccagtgttacaaccaattaaccaattctgattagaaaaactc

Figure 52C continued atcgagcatcaaatgaaactgcaatttattcatatcaggattatcaataccatatttttgaaaaagccgtttctg
taatgaaggagaaaactcaccgaggcagttccataggatggcaagatcctggtatcggtctgcgattccgactcg
tccaacatcaatacaacctattaatttcccctcgtcaaaaataaggttatcaagtgagaaatcaccatgagtgac
gactgaatccggtgagaatggcaaaagcttatgcatttctttccagacttgttcaacaggccagccattacgctc
gtcatcaaaatcactcgcatcaaccaaaccgttattcattcgtgattgcgcctgagcgagacgaaatacgcgatc
gctgttaaaaggacaattacaaacaggaatcgaatgcaaccggcgcaggaacactgccagcgcatcaacaatatt
ttcacctgaatcaggatattcttctaatacctggaatgctgttttcccggggatcgcagtggtgagtaaccatgc
atcatcaggagtacggataaaatgcttgatggtcggaagaggcataaattccgtcagccagtttagtctgaccat
ctcatctgtaacatcattggcaacgctacctttgccatgtttcagaaacaactctggcgcatcgggcttcccata
caatcgatagattgtcgcacctgattgcccgacattatcgcgagcccatttatacccatataaatcagcatccat
gttggaatttaatcgcggcctcgagcaagacgtttcccgttgaatatggctcataacaccccttgtattactgtt
tatgtaagcagacagttttattgttcatgatgatatatttttatcttgtgcaatgtaacatcagagattttgaga
cacaacgtggctttccccccccccccattattgaagcatttatcagggttattgtctcatgagcggatacatatt
tgaatgtatttagaaaaataaacaaataggggttccgcgcacatttccccgaaaagtgccacctgacgtctaaga
aaccattattatcatgacattaacctataaaaataggcgtatcacgaggccctttcgtc

Figure 52D

AA sequence efiptqtfynrryqprpwaprptiqvirprprpqrqagqlaqlisavnkltmravpqqkprrnaknkkqrqkkqa
pqndpkqkkqppqkkpaqkkkkpgrrermcmkiendcifevkhegkvmgyaclvgdkvmkpahvkgtidnadlak
lafkrsskydlecaqipvhmksdaskfthekpegyynwhhgavqysggrftiptgagkpgdsgrpifdnkgrvva
ivlgganegartalsvvtwnkdivtkitpegaeewslalpvlcllanttfpcsqppctpccyekepestlrmled
nvmrpgyyqllkasltcsphrqrrstkdnfnvykatrpylahcpdcgeghschspialerirneatdgtlkiqvs
lqigiktddshdwtklrymdshtpadaeragllvrtsapctitgtmghfilarcpkgetltvgftdsrkishtct
hpfhheppvigrerfhsrpqhgkelpcstyvqstaataeeievhmppdtpdrtlmtqqsgnvkitvngqtvrykc
ncggsnegltttdkvinnckidqchaavtnhknwqynsplvprnaelgdrkgkihipfplanvtcrvpkarnptv
tygknqvtmllypdhptllsyrnmgqepnyheewvthkkevtltvpteglevtwgnnepykywpqmstngtahgh
pheiilyyyelyptmtvvivsvasfvllsmvgtavgmcvcarrrcitpyeltpgatvpfllsllccvrttkaaty
yeaaaylwneqqplfwlqaliplaalivlcnclkllpccktlaflavmsigahtvsayehvtvipntvgvpykt
lvnrpgyspmvlemelqsvtleptlsldyitceyktvipspyvkccgtaeckdkslpdysckvftgvypfmwgga
ycfcdaentqlseahveksescktefasayrahtasasaklrvlyqgnnitvaayangdhavtvkdakfvvgpms
sawtpfdnkivvykgdvynmdyppfgagrpgqfgdiqsrtpeskdvyantqlvlqrpaagtvhvpysqapsgfky
wlkergaslqhtapfgcqiatnpvravncavgnipisidipdaaftrvvdapsvtdmscevpacthssdfggvai
ikytaskkgkcavhsmtnavtireadvevegnsqlqisfstalasaefrvqvcstqvhcaaachppkdhivnypa
shttlgvqdisttamswvqkitggvglivavaalilivvlcvsfsrh

Figure 53A

CMV/R Ross River Virus T48 capsid R71N

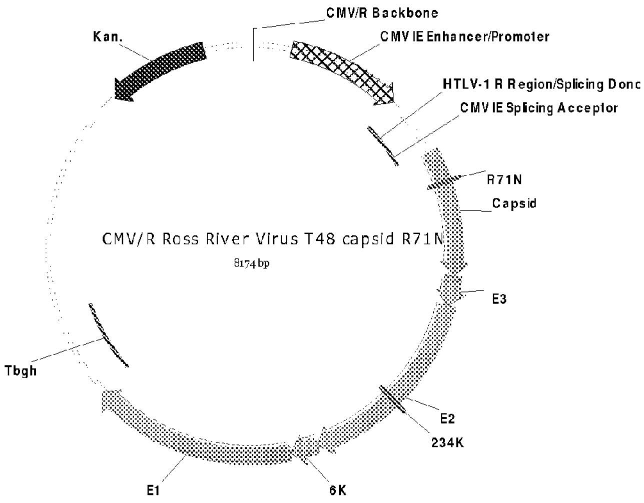

Figure 53B
Insert sequence of capsid atgaattacataccaacccagactttttacggacgccgttggcggcctcgcccggcgttccgtccatggcaggtgccgatgcagccgacacctactatggttaca
cccatgctgcaagcaccagacctacaggcccaacagatgcaacaactgatcagcgctgtctctgcattaaccaccaaacagaatgtaaaagcaccaaaaggg
caaaataagaagaaacagcagaaaccaaaggaaaagaaggaaaaccagaagaaaaagccgacgcaaaagaagaagcagcagcagaaaccaaaaccac
aggctaagaagaagaaaccagggagaagagaaagaatgtgcatgaagatcgagaatgactgcatattcgaggtcaaactggatggcaaggttaccggttat
gcgtgcctagtcggagacaaggtcatgaagccggctcacgttaaaggcacaattgataacccagaccttgcgaagctgacttacaagaaatccagtaagtatg
acctcgaatgcgcccagataccagtgcacatgaagtccgacgcctccaagtacacacatgaaaaacccgaaggtcattacaattggcaccatggagcagtgca
gtacagcggaggaaggtttaccatccccacaggcgccggcaaaccgggagatagcggtaggcctatttttgacaacaaagggcgagtagtggccatcgtgtta
ggcggggccaacgaaggtgctcgcactgcgctgtctgtggtgacgtggacaaaagacatggtcactcgggtaacgccagaaggaactgaagagtgg Figure 53C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc

Figure 53C continued accagacataatagctgacagactaacagactgttcctttccatgggtcttttctgcagtcaccgtcgtcgacac
gtgtgatcagatatcgcggccgctctagacaccatgaattacataccaacccagactttttacggacgccgttgg
cggcctcgcccggcgttccgtccatggcaggtgccgatgcagccgacacctactatggttacacccatgctgcaa
gcaccagacctacaggcccaacagatgcaacaactgatcagcgctgtctctgcattaaccaccaaacagaatgta
aaagcaccaaaagggcaaaataagaagaaacagcagaaaccaaaggaaaagaaggaaaaccagaagaaaaagccg
acgcaaaagaagaagcagcagcagaaaccaaaaccacaggctaagaagaagaaaccagggagaagagaaagaatg
tgcatgaagatcgagaatgactgcatattcgaggtcaaactggatggcaaggttaccggttatgcgtgcctagtc
ggagacaaggtcatgaagccggctcacgttaaaggcacaattgataacccagaccttgcgaagctgacttacaag
aaatccagtaagtatgacctcgaatgcgcccagataccagtgcacatgaagtccgacgcctccaagtacacacat
gaaaaacccgaaggtcattacaattggcaccatggagcagtgcagtacagcggaggaaggtttaccatccccaca
ggcgccggcaaaccgggagatagcggtaggcctatttttgacaacaaagggcgagtagtggccatcgtgttaggc
ggggccaacgaaggtgctcgcactgcgctgtctgtggtgacgtggacaaaagacatggtcactcgggtaacgcca
gaaggaactgaagagtggtctgccgcgctgatgatgtgtatccttgccaacacctctttcccctgctcatcacct
ccctgctacccctgctgctacgaaaaacagccagaacagacactgcggatgctggaagacaatgtgaatagacca
gggtactatgagctactggaagcgtccatgacatgcagaaacagatcacgccaccgccgtagtgtaacagagcac
ttcaatgtgtataaggctactagaccgtacttagcgtattgcgctgactgtggggacgggtacttctgctatagc
ccagttgctatcgagaagatccgagatgaggcgtctgacggcatgctcaagatccaagtctccgcccaaataggt
ctggacaaggcaggtacccacgcccacacgaagatccgatatatggctggtcatgatgttcaggaatctaagaga
gattccttgagggtgtacacgtccgcagcgtgctctatacatgggacgatggacacttcatcgtcgcacattgt
ccgccaggcgactacctcaaggtttcgttcgaggacgcagattcacacgtgaaggcatgtaaggtccaatacaag
cacgacccattgccggtgggtagagagaagttcgtggttagaccccactttggcgtagagctgccatgcacctca
taccagctgacaacagctcccaccgacgaggagatcgacatgcacacaccgccagatataccggatcgcaccctg
ctatcacagacggcgggcaacgtcaaaataacagcaggcggcaggactatcaggtacaattgtacctgtggccgt
gacaacgtaggcactaccagtactgacaagaccatcaacacatgcaagattgaccaatgccatgctgccgttacc
agccatgacaaatggcaatttacctctccatttgttcccagggctgatcagacagctaggagggggcaaagtgcat
gttccattccctttgactaacgtcacctgccgagtgccgttggctcgagcgccggatgtcacctatggtaagaag
gaggtgaccctgagattacacccagatcatccgacgctcttctcctataggagtttaggagccgaaccgcacccg
tacgaggagtgggttgacaagttctctgagcgcatcatcccagtgacggaagaagggattgagtaccagtggggc
aacaacccgccggtccgcctatgggcgcaactgacgaccgagggcaaacccccatggctggccacatgaaatcatt
cagtactattatggactataccccgccgccaccattgccgcagtatccggggcgagtctgatggccctcctaact
ctagcggccacatgctgcatgctggccaccgcgaggagaaagtgcctaacaccatacgccttgacgccaggagcg
gtggtaccgttgacactggggctgctttgctgcgcaccgagggcgaacgcagcatcattcgctgagactatggca
tatctgtgggacgagaacaaaaccctctttggatggaattcgcggccccagccgcagcgcttgctttgctggca
tgctgtatcaaaagcctgatctgctgttgtaagccatttttcttttttagtgttactgagcctgggagcctccgca
aaagcttacgagcacacagccacaattccgaatgtggtggggttcccgtataaggctcacattgaaaggaatggc
ttctcgcccatgactctgcagcttgaagtggtggagacaagcttggaacccacacttaacctggagtacattacc
tgcgaatacaagacggtggtcccttcgccattcatcaaatgttgcggaacatcagaatgctcatccaaggagcag
ccagactaccaatgcaaggtgtacacgggtgtatacccattcatgtggggtggagcctactgtttctgcgactcc
gagaacacgcagctcagcgaggcctatgtcgacaggtcagacgtttgcaaacatgatcacgcatcggcctacaag
gcacacacggcctctctaaaagcaacaatcaggatcagttatggcaccatcaaccagaccaccgaggccttcgtt
aatggtgaacacgcggtcaacgtgggcggaagcaagttcatctttggaccgatctcaacagcttggtcaccgttc
gacaataaaattgtcgtgtataaagatgatgtctacaaccaggacttcccaccctacggatcaggccagccgggt
agattcggagacattcagagcaggacagtggagagcaaagacttgtatgccaacacggccctaaaactctcaaga
ccatcacccggggttgtgcatgtgccatacacgcagacaccatccggatttaaatattggctgaaggagaaagga
tcttcattgaatacaaaggcccctttttggctgcaagataaagaccaatccagtcagagccatggattgtgcagtt
ggcagtatacctgtgtcgatggacatacctgacagtgcattcacacgagtggtagatgccccggctgtaacagac
ctgagctgccaggtagtggtctgtacacactcctccgatttcggaggagttgccacattgtcttacaaaacggac
aaacccggcaagtgcgctgtccactcacattccaacgtcgcaacgttgcaagaggcgacggtggatgtcaaggag
gatggcaaggtcacagtgcacttttccacggcgtccgcctccccggccttcaaagtgtccgtctgtgacgcaaaa
acaacgtgcacggcggcgtgcgagcctccaaaagaccacatcgtcccttatggggcgagccataacaaccaggtc
tttccggacatgtcaggaactgcgatgacgtgggtgcagaggctggccagtgggttaggtgggctggctctcatc
gcggtggttgtgctggtcttggtaacctgcataacaatgcgtcggtaaggatccagatctgctgtgccttctagt
tgccagccatctgttgtttgcccctcccccgtgccttccttgaccctggaaggtgccactcccactgtcctttcc
taataaaatgaggaaattgcatcgcattgtctgagtaggtgtcattctattctggggggtggggtggggcaggac
agcaagggggaggattgggaagacaatagcaggcatgctggggatgcggtgggctctatgggtacccaggtgctg
aagaattgacccggttcctcctgggccagaaagaagcaggcacatccccttctctgtgacacaccctgtccacgc
ccctggttcttagttccagccccactcataggacactcatagctcaggagggctccgccttcaatcccacccgct
aaagtacttggagcggtctctccctccctcatcagcccaccaaaccaaacctagcctccaagagtgggaagaaat
taaagcaagataggctattaagtgcagagggagagaaaatgcctccaacatgtgaggaagtaatgagagaaatca
tagaattttaaggccatgatttaaggccatcatggccttaatcttccgcttcctcgctcactgactcgctgcgct
cggtcgttcggctgcggcgagcggtatcagctcactcaaaggcggtaatacggttatccacagaatcaggggata

Figure 53C continued acgcaggaaagaacatgtgagcaaaaggccagcaaaaggccaggaaccgtaaaaaggccgcgttgctggcgtttt
tccataggctccgcccccctgacgagcatcacaaaaatcgacgctcaagtcagaggtggcgaaacccgacaggac
tataaagataccaggcgtttccccctggaagctccctcgtgcgctctcctgttccgaccctgccgcttaccggat
acctgtccgcctttctcccttcgggaagcgtggcgctttctcatagctcacgctgtaggtatctcagttcggtgt
aggtcgttcgctccaagctgggctgtgtgcacgaaccccccgttcagcccgaccgctgcgccttatccggtaact
atcgtcttgagtccaacccggtaagacacgacttatcgccactggcagcagccactggtaacaggattagcagag
cgaggtatgtaggcggtgctacagagttcttgaagtggtggcctaactacggctacactagaagaacagtatttg
gtatctgcgctctgctgaagccagttaccttcggaaaaagagttggtagctcttgatccggcaaacaaaccaccg
ctggtagcggtggtttttttgtttgcaagcagcagattacgcgcagaaaaaaaggatctcaagaagatcctttga
tcttttctacggggtctgacgctcagtggaacgaaaactcacgttaagggattttggtcatgagattatcaaaaa
ggatcttcacctagatccttttaaattaaaaatgaagttttaaatcaatctaaagtatatatgagtaaacttggt
ctgacagttaccaatgcttaatcagtgaggcacctatctcagcgatctgtctatttcgttcatccatagttgcct
gactcggggggggggggcgctgaggtctgcctcgtgaagaaggtgttgctgactcataccaggcctgaatcgccc
catcatccagccagaaagtgagggagccacggttgatgagagctttgttgtaggtggaccagttggtgattttga
acttttgctttgccacggaacggtctgcgttgtcgggaagatgcgtgatctgatccttcaactcagcaaaagttc
gatttattcaacaaagccgccgtcccgtcaagtcagcgtaatgctctgccagtgttacaaccaattaaccaattc
tgattagaaaaactcatcgagcatcaaatgaaactgcaatttattcatatcaggattatcaataccatatttttg
aaaaagccgtttctgtaatgaaggagaaaactcaccgaggcagttccataggatggcaagatcctggtatcggtc
tgcgattccgactcgtccaacatcaatacaacctattaatttcccctcgtcaaaaataaggttatcaagtgagaa
atcaccatgagtgacgactgaatccggtgagaatggcaaaagcttatgcatttctttccagacttgttcaacagg
ccagccattacgctcgtcatcaaaatcactcgcatcaaccaaaccgttattcattcgtgattgcgcctgagcgag
acgaaatacgcgatcgctgttaaaaggacaattacaaacaggaatcgaatgcaaccggcgcaggaacactgccag
cgcatcaacaatattttcacctgaatcaggatattcttctaatacctggaatgctgttttcccggggatcgcagt
ggtgagtaaccatgcatcatcaggagtacggataaaatgcttgatggtcggaagaggcataaattccgtcagcca
gtttagtctgaccatctcatctgtaacatcattggcaacgctacctttgccatgtttcagaaacaactctggcgc
atcgggcttcccatacaatcgatagattgtcgcacctgattgcccgacattatcgcgagcccatttatacccata
taaatcagcatccatgttggaatttaatcgcggcctcgagcaagacgtttcccgttgaatatggctcataacacc
ccttgtattactgtttatgtaagcagacagttttattgttcatgatgatatatttttatcttgtgcaatgtaaca
tcagagattttgagacacaacgtggctttccccccccccccattattgaagcatttatcagggttattgtctcat
gagcggatacatatttgaatgtatttagaaaaataaacaaataggggttccgcgcacatttccccgaaaagtgcc
acctgacgtctaagaaaccattattatcatgacattaacctataaaaataggcgtatcacgaggccctttcgtc

Figure 53D

Amino acid sequence mnyiptqtfygrrwrprpafrpwqvpmqptptmvtpmlqapdlqaqqmqqlisavsalttkqnvkapkgqnkkkq
qkpkekkenqkkkptqkkkqqqkpkpqakkkkpgrrermcmkiendcifevkldgkvtgyaclvgdkvmkpahvk
gtidnpdlakltykksskydlecaqipvhmksdaskythekpeghynwhhgavqysggrftiptgagkpgdsgrp
ifdnkgrvvaivlgganegartalsvvtwtkdmvtrvtpegteewsaalmmcilantsfpcssppcypccyekqp
eqtlrmlednvnrpgyyelleasmtcrnrsrhrrsvtehfnvykatrpylaycadcgdgyfcyspvaiekirdea
sdgmlkiqvsaqigldkagthahtkirymaghdvqeskrdslrvytsaacsihgtmghfivahcppgdylkvsfe
dadshvkackvqykhdplpvgrekfvvrphfgvelpctsyqlttaptdeeidmhtppdipdrtllsqtagnvkit
aggrtiryntcgrdnvgttstdktintckidqchaavtshdkwqftspfvpradqtarrgkvhvpfpltnvtcr
vplarapdvtygkkevtlrlhpdhptlfsyrslgaephpyeewvdkfseriipvteegieyqwgnnppvrlwaql
ttegkphgwpheiiqyyyglypaatiaavsgaslmalltlaatccmlatarrkcltpyaltpgavvpltlgllcc
apranaasfaetmaylwdenktlfwmefaapaaalallaccikslicccckpfsflvllslgasakayehtatipn
vvgfpykahierngfspmtlqlevvetsleptlnleyitceyktvvpspfikccgtsecsskeqpdyqckvytgv
ypfmwggaycfcdsentqlseayvdrsdvckhdhasaykahtaslkatirisygtinqtteafvngehavnvggs
kfifgpistawspfdnkivvykddvynqdfppygsgqpgrfgdiqsrtveskdlyantalklsrpspgvvhvpyt
qtpsgfkywlkekgsslntkapfgckiktnpvramdcavgsipvsmdipdsaftrvvdapavtdlscqvvvcths
sdfggvatlsyktdkpgkcavhshsnvatlqeatvdvkedgkvtvhfstasaspafkvsvcdakttctaaceppk
dhivpygashnnqvfpdmsgtamtwvqrlasglgglaliavvvlvlvtcitmrr

Figure 54A

CMV/R Ross River Virus T48 capsid R71N K72N

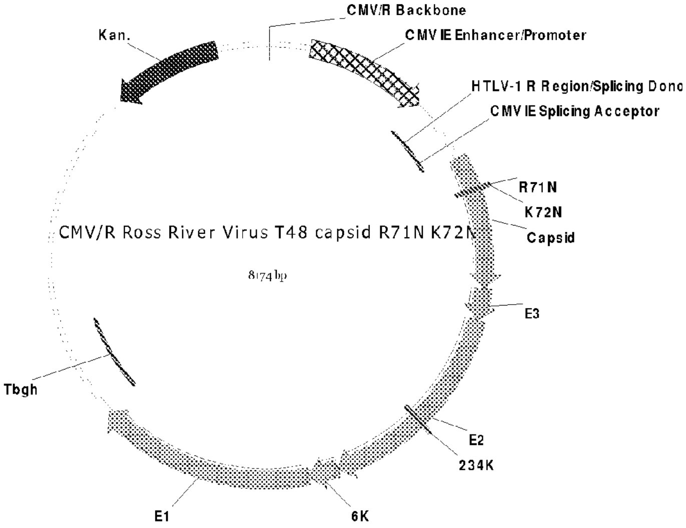

Figure 54B

Insert sequence of capsid atgaattacataccaacccagactttttacggacgccgttggcggcctcgcccggcgttccgtccatggcaggtg
ccgatgcagccgacacctactatggttacacccatgctgcaagcaccagacctacaggcccaacagatgcaacaa
ctgatcagcgctgtctctgcattaaccaccaaacagaatgtaaaagcaccaaaagggcaaaataacaagaaacag
cagaaaccaaaggaaaagaaggaaaaccagaagaaaaagccgacgcaaaagaagaagcagcagcagaaaccaaaa
ccacaggctaagaagaagaaaccagggagaagagaaagaatgtgcatgaagatcgagaatgactgcatattcgag
gtcaaactggatggcaaggttaccggttatgcgtgcctagtcggagacaaggtcatgaagccggctcacgttaaa
ggcacaattgataacccagaccttgcgaagctgacttacaagaaatccagtaagtatgacctcgaatgcgcccag
ataccagtgcacatgaagtccgacgcctccaagtacacacatgaaaaacccgaaggtcattacaattggcaccat
ggagcagtgcagtacagcggaggaaggtttaccatccccacaggcgccggcaaaccgggagatagcggtaggcct
atttttgacaacaaagggcgagtagtggccatcgtgttaggcggggccaacgaaggtgctcgcactgcgctgtct
gtggtgacgtggacaaaagacatggtcactcgggtaacgccagaaggaactgaagagtgg

Figure 54C

Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc

Figure 54C continued aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatgaattacataccaacccagacttttacggacgccgttgg
cggcctcgcccggcgttccgtccatggcaggtgccgatgcagccgacacctactatggttacacccatgctgcaa
gcaccagacctacaggcccaacagatgcaacaactgatcagcgctgtctctgcattaaccaccaaacagaatgta
aaagcaccaaaagggcaaaataacaagaaacagcagaaaccaaaggaaaagaaggaaaaccagaagaaaaagccg
acgcaaaagaagaagcagcagcagaaaccaaaaccacaggctaagaagaagaaaccagggagaagagaaagaatg
tgcatgaagatcgagaatgactgcatattcgaggtcaaactggatggcaaggttaccggttatgcgtgcctagtc
ggagacaaggtcatgaagccggctcacgttaaaggcacaattgataacccagaccttgcgaagctgacttacaag
aaatccagtaagtatgacctcgaatgcgcccagataccagtgcacatgaagtccgacgcctccaagtacacacat
gaaaaacccgaaggtcattacaattggcaccatggagcagtgcagtacagcggaggaaggtttaccatccccaca
ggcgccggcaaaccgggagatagcggtaggcctatttttgacaacaaaggcgagtagtggccatcgtgttaggc
ggggccaacgaaggtgctcgcactgcgctgtctgtggtgacgtggacaaaagacatggtcactcgggtaacgcca
gaaggaactgaagagtggtctgccgcgctgatgatgtgtatccttgccaacacctctttcccctgctcatcacct
ccctgctacccctgctgctacgaaaaacagccagaacagacactgcggatgctggaagacaatgtgaatagacca
gggtactatgagctactggaagcgtccatgacatgcagaaacagatcacgccaccgccgtagtgtaacagagcac
ttcaatgtgtataaggctactagaccgtacttagcgtattgcgctgactgtggggacgggtacttctgctatagc
ccagttgctatcgagaagatccgagatgaggcgtctgacggcatgctcaagatccaagtctccgcccaaataggt
ctggacaaggcaggtacccacgcccacacgaagatccgatatatggctggtcatgatgttcaggaatctaagaga
gattccttgagggtgtacacgtccgcagcgtgctctatacatgggacgatggacacttcatcgtcgcacattgt
ccgccaggcgactacctcaaggtttcgttcgaggacgcagattcacacgtgaaggcatgtaaggtccaatacaag
cacgacccattgccggtgggtagagagaagttcgtggttagaccccactttggcgtagagctgccatgcacctca
taccagctgacaacagctcccaccgacgaggagatcgacatgcacacaccgccagatataccggatcgcaccctg
ctatcacagacggcgggcaacgtcaaaataacagcaggcggcaggactatcaggtacaattgtacctgtggccgt
gacaacgtaggcactaccagtactgacaagaccatcaacacatgcaagattgaccaatgccatgctgccgttacc
agccatgacaaatggcaatttacctctccatttgttcccagggctgatcagacagctaggagggcaaagtgcat
gttccattccctttgactaacgtcacctgccgagtgccgttggctcgagcgccggatgtcacctatggtaagaag
gaggtgaccctgagattacacccagatcatccgacgctcttctcctataggagtttaggagccgaaccgcacccg
tacgaggagtgggttgacaagttctctgagcgcatcatcccagtgacggaagaaggattgagtaccagtggggc
aacaacccgccggtccgcctatgggcgcaactgacgaccgagggcaaaccccatggctggccacatgaaatcatt
cagtactattatggactataccccgccgccaccattgccgcagtatccggggcgagtctgatggccctcctaact
ctagcggccacatgctgcatgctggccaccgcgaggagaaagtgcctaacaccatacgccttgacgccaggagcg
gtggtaccgttgacactggggctgctttgctgcgcaccgagggcgaacgcagcatcattcgctgagactatggca
tatctgtgggacgagaacaaaaccctcttttggatggaattcgcggccccagccgcagcgcttgctttgctggca
tgctgtatcaaaagcctgatctgctgttgtaagccatttttctttttttagtgttactgagcctgggagcctccgca
aaagcttacgagcacacagccacaattccgaatgtggtggggttcccgtataaggctcacattgaaaggaatggc
ttctcgcccatgactctgcagcttgaagtggtggagacaagcttggaacccacacttaacctggagtacattacc
tgcgaatacaagacggtggtcccttcgccattcatcaaatgttgcggaacatcagaatgctcatccaaggagcag
ccagactaccaatgcaaggtgtacacgggtgtatacccattcatgtggggtggagcctactgtttctgcgactcc
gagaacacgcagctcagcgaggcctatgtcgacaggtcagacgtttgcaaacatgatcacgcatcggcctacaag
gcacacacggcctctctaaaagcaacaatcaggatcagttatggcaccatcaaccagaccaccgaggccttcgtt
aatggtgaacacgcggtcaacgtgggcggaagcaagttcatctttggaccgatctcaacagcttggtcaccgttc
gacaataaaattgtcgtgtataaagatgatgtctacaaccaggacttcccaccctacggatcaggccagccgggt
agattcggagacattcagagcaggacagtggagagcaaagacttgtatgccaacacggccctaaaactctcaaga
ccatcacccggggttgtgcatgtgccatacacgcagacaccatccggatttaaatattggctgaaggagaaagga
tcttcattgaatacaaaggccccttttggctgcaagataaagaccaatccagtcagagccatggattgtgcagtt
ggcagtatacctgtgtcgatggacatacctgacagtgcattcacacgagtggtagatgccccggctgtaacagac
ctgagctgccaggtagtggtctgtacacactcctccgatttcggaggagttgccacattgtcttacaaaacggac
aaacccggcaagtgcgctgtccactcacattccaacgtcgcaacgttgcaagaggcgacggtggatgtcaaggag
gatggcaaggtcacagtgcacttttccacggcgtccgcctccccggccttcaaagtgtccgtctgtgacgcaaaa
acaacgtgcacggcggcgtgcgagcctccaaaagaccacatcgtcccttatggggcgagccataacaaccaggtc
tttccggacatgtcaggaactgcgatgacgtgggtgcagaggctggccagtgggttaggtggcctggctctcatc
gcggtggttgtgctggtcttggtaacctgcataacaatgcgtcggtaaggatccagatctgctgtgccttctagt
tgccagccatctgttgtttgcccctcccccgtgccttccttgaccctggaaggtgccactcccactgtcctttcc
taataaaatgaggaaattgcatcgcattgtctgagtaggtgtcattctattctggggggtggcgtggggcaggac
agcaagggggaggattgggaagacaatagcaggcatgctggggatgcggtgggctctatgggtacccaggtgctg
aagaattgacccggttcctcctgggccagaaagaagcaggcacatccccttctctgtgacacaccctgtccacgc
ccctggttcttagttccagccccactcataggacactcatagctcaggagggctccgccttcaatcccacccgct
aaagtacttggagcggtctctccctccctcatcagcccaccaaaccaaacctagcctccaagagtgggaagaaat
taaagcaagataggctattaagtgcagagggagagaaaatgcctccaacatgtgaggaagtaatgagagaaatca

Figure 54C continued tagaattttaaggccatgatttaaggccatcatggccttaatcttccgcttcctcgctcactgactcgctgcgct
cggtcgttcggctgcggcgagcggtatcagctcactcaaaggcggtaatacggttatccacagaatcaggggata
acgcaggaaagaacatgtgagcaaaaggccagcaaaaggccaggaaccgtaaaaaggccgcgttgctggcgtttt
tccataggctccgcccccctgacgagcatcacaaaaatcgacgctcaagtcagaggtggcgaaacccgacaggac
tataaagataccaggcgtttccccctggaagctccctcgtgcgctctcctgttccgaccctgccgcttaccggat
acctgtccgcctttctcccttcgggaagcgtggcgctttctcatagctcacgctgtaggtatctcagttcggtgt
aggtcgttcgctccaagctgggctgtgtgcacgaaccccccgttcagcccgaccgctgcgccttatccggtaact
atcgtcttgagtccaacccggtaagacacgacttatcgccactggcagcagccactggtaacaggattagcagag
cgaggtatgtaggcggtgctacagagttcttgaagtggtggcctaactacggctacactagaagaacagtatttg
gtatctgcgctctgctgaagccagttaccttcggaaaaagagttggtagctcttgatccggcaaacaaaccaccg
ctggtagcggtggtttttttgtttgcaagcagcagattacgcgcagaaaaaaaggatctcaagaagatcctttga
tcttttctacggggtctgacgctcagtggaacgaaaactcacgttaagggattttggtcatgagattatcaaaaa
ggatcttcacctagatccttttaaattaaaaatgaagttttaaatcaatctaaagtatatatgagtaaacttggt
ctgacagttaccaatgcttaatcagtgaggcacctatctcagcgatctgtctatttcgttcatccatagttgcct
gactcggggggggggcgctgaggtctgcctcgtgaagaaggtgttgctgactcataccaggcctgaatcgccc
catcatccagccagaaagtgagggagccacggttgatgagagctttgttgtaggtggaccagttggtgattttga
acttttgctttgccacggaacggtctgcgttgtcgggaagatgcgtgatctgatccttcaactcagcaaaagttc
gatttattcaacaaagccgccgtcccgtcaagtcagcgtaatgctctgccagtgttacaaccaattaaccaattc
tgattagaaaaactcatcgagcatcaaatgaaactgcaatttattcatatcaggattatcaataccatatttttg
aaaaagccgtttctgtaatgaaggagaaaactcaccgaggcagttccataggatggcaagatcctggtatcggtc
tgcgattccgactcgtccaacatcaatacaacctattaatttcccctcgtcaaaaataaggttatcaagtgagaa
atcaccatgagtgacgactgaatccggtgagaatggcaaaagcttatgcatttctttccagacttgttcaacagg
ccagccattacgctcgtcatcaaaatcactcgcatcaaccaaaccgttattcattcgtgattgcgcctgagcgag
acgaaatacgcgatcgctgttaaaaggacaattacaaacaggaatcgaatgcaaccggcgcaggaacactgccag
cgcatcaacaatattttcacctgaatcaggatattcttctaatacctggaatgctgttttcccggggatcgcagt
ggtgagtaaccatgcatcatcaggagtacggataaaatgcttgatggtcggaagaggcataaattccgtcagcca
gtttagtctgaccatctcatctgtaacatcattggcaacgctacctttgccatgtttcagaaacaactctggcgc
atcgggcttcccatacaatcgatagattgtcgcacctgattgcccgacattatcgcgagcccatttatacccata
taaatcagcatccatgttggaatttaatcgcggcctcgagcaagacgtttcccgttgaatatggctcataacacc
ccttgtattactgtttatgtaagcagacagttttattgttcatgatgatatatttttatcttgtgcaatgtaaca
tcagagattttgagacacaacgtggctttcccccccccccattattgaagcatttatcagggttattgtctcat
gagcggatacatatttgaatgtatttagaaaaataaacaaataggggttccgcgcacatttccccgaaaagtgcc
acctgacgtctaagaaaccattattatcatgacattaacctataaaaataggcgtatcacgaggccctttcgtc

Figure 54D

Amino acid sequence mnyiptqtfygrrwrprpafrpwqvpmqptptmvtpmlqapdlqaqqmqqlisavsalttkqnvkapkgqnnkkq
qkpkekkenqkkkptqkkkqqqkpkpqakkkkpgrrermcmkiendcifevkldgkvtgyaclvgdkvmkpahvk
gtidnpdlakltykksskydlecaqipvhmksdaskythekpeghynwhhgavqysggrftiptgagkpgdsgrp
ifdnkgrvvaivlgganegartalsvvtwtkdmvtrvtpegteewsaalmmcilantsfpcssppcypccyekqp
eqtlrmlednvnrpgyyelleasmtcrnrsrhrrsvtehfnvykatrpylaycadcgdgyfcyspvaiekirdea
sdgmlkiqvsaqigldkagthahtkirymaghdvqeskrdslrvytsaacsihgtmghfivahcppgdylkvsfe
dadshvkackvqykhdplpvgrekfvvrphfgvelpctsyqlttaptdeeidmhtppdipdrtllsqtagnvkit
aggrtirynctcgrdnvgttstdktintckidqchaavtshdkwqftspfvpradqtarrgkvhvpfpltnvtcr
vplarapdvtygkkevtlrlhpdhptlfsyrslgaephpyeewvdkfseriipvteegieyqwgnnppvrlwaql
ttegkphgwpheiiqyyyglypaatiaavsgaslmalltlaatccmlatarrkcltpyaltpgavvpltlgllcc
apranaasfaetmaylwdenktlfwmefaapaaalallaccikslicccckpfsflvllslgasakayehtatipn
vvgfpykahierngfspmtlqlevvetsleptlnleyitceyktvvpspfikccgtsecsskeqpdyqckvytgv
ypfmwggaycfcdsentqlseayvdrsdvckhdhasaykahtaslkatirisygtinqtteafvngehavnvggs
kfifgpistawspfdnkivvykddvynqdfppygsgqpgrfgdiqsrtveskdlyantalklsrpspgvvhvpyt
qtpsgfkywlkekgsslntkapfgckiktnpvramdcavgsipvsmdipdsaftrvvdapavtdlscqvvvcths
sdfggvatlsyktdkpgkcavhshsnvatlqeatvdvkedgkvtvhfstasaspafkvsvcdakttctaaceppk
dhivpygashnnqvfpdmsgtamtwvqrlasglgglaliavvvlvlvtcitmrr

Figure 55A

CMV/R Ross River Virus T48 capsid R71N K72N K73N

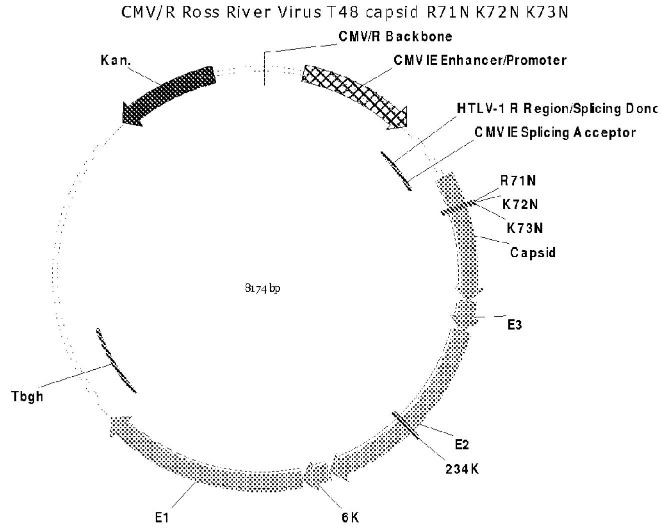

Figure 55B

Insert sequence of capsid atgaattacataccaacccagactttttacggacgccgttggcggcctcgcccggcgttccgtccatggcaggtg
ccgatgcagccgacacctactatggttacacccatgctgcaagcaccagacctacaggcccaacagatgcaacaa
ctgatcagcgctgtctctgcattaaccaccaaacagaatgtaaaagcaccaaagggcaaaataacaataaacag
cagaaaccaaaggaaaagaaggaaaaccagaagaaaaagccgacgcaaaagaagaagcagcagcagaaaccaaaa
ccacaggctaagaagaagaaaccagggagaagagaaagaatgtgcatgaagatcgagaatgactgcatattcgag
gtcaaactggatggcaaggttaccggttatgcgtgcctagtcggagacaaggtcatgaagccggctcacgttaaa
ggcacaattgataacccagaccttgcgaagctgacttacaagaaatccagtaagtatgacctcgaatgcgcccag
ataccagtgcacatgaagtccgacgcctccaagtacacacatgaaaaacccgaaggtcattacaattggcaccat
ggagcagtgcagtacagcggaggaaggtttaccatccccacaggcgccggcaaaccgggagatagcggtaggcct
atttttgacaacaaagggcgagtagtggccatcgtgttaggcggggccaacgaaggtgctcgcactgcgctgtct
gtggtgacgtggacaaaagacatggtcactcgggtaacgccagaaggaactgaagagtgg

Figure 55C

Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga

Figure 55C continued ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatgaattacataccaacccagacttttacggacgccgttgg
cggcctcgcccggcgttccgtccatggcaggtgccgatgcagccgacacctactatggttacacccatgctgcaa
gcaccagacctacaggcccaacagatgcaacaactgatcagcgctgtctctgcattaaccaccaaacagaatgta
aaagcaccaaaagggcaaaataacaataaacagcagaaaccaaaggaaaagaaggaaaaccagaagaaaaagccg
acgcaaaagaagaagcagcagcagaaaccaaaaccacaggctaagaagaagaaaccagggagaagagaaagaatg
tgcatgaagatcgagaatgactgcatattcgaggtcaaactggatggcaaggttaccggttatgcgtgcctagtc
ggagacaaggtcatgaagccggctcacgttaaaggcacaattgataacccagaccttgcgaagctgacttacaag
aaatccagtaagtatgacctcgaatgcgcccagataccagtgcacatgaagtccgacgcctccaagtacacacat
gaaaaacccgaaggtcattacaattggcaccatggagcagtgcagtacagcggaggaaggtttaccatccccaca
ggcgccggcaaaccgggagatagcggtaggcctatttttgacaacaaagggcgagtagtggccatcgtgttaggc
ggggccaacgaaggtgctcgcactgcgctgtctgtggtgacgtggacaaaagacatggtcactcgggtaacgcca
gaaggaactgaagagtggtctgccgcgctgatgatgtgtatccttgccaacacctctttcccctgctcatcacct
ccctgctacccctgctgctacgaaaaacagccagaacagacactgcggatgctggaagacaatgtgaatagacca
gggtactatgagctactggaagcgtccatgacatgcagaaacagatcacgccaccgccgtagtgtaacagagcac
ttcaatgtgtataaggctactagaccgtacttagcgtattgcgctgactgtggggacgggtacttctgctatagc
ccagttgctatcgagaagatccgagatgaggcgtctgacggcatgctcaagatccaagtctccgcccaaataggt
ctggacaaggcaggtacccacgcccacacgaagatccgatatatggctggtcatgatgttcaggaatctaagaga
gattccttgagggtgtacacgtccgcagcgtgctctatacatgggacgatgggacacttcatcgtcgcacattgt
ccgccaggcgactacctcaaggtttcgttcgaggacgcagattcacacgtgaaggcatgtaaggtccaatacaag
cacgacccattgccggtgggtagagagaagttcgtggttagaccccactttggcgtagagctgccatgcacctca
taccagctgacaacagctcccaccgacgaggagatcgacatgcacacaccgccagatataccggatcgcaccctg
ctatcacagacggcgggcaacgtcaaaataacagcaggcggcaggactatcaggtacaattgtacctgtggccgt
gacaacgtaggcactaccagtactgacaagaccatcaacacatgcaagattgaccaatgccatgctgccgttacc
agccatgacaaatggcaatttacctctccatttgttcccagggctgatcagacagctaggaggggcaaagtgcat
gttccattccctttgactaacgtcacctgccgagtgccgttggctcgagcgccggatgtcacctatggtaagaag
gaggtgaccctgagattacacccagatcatccgacgctcttctcctataggagtttaggagccgaaccgcacccg
tacgaggagtgggttgacaagttctctgagcgcatcatcccagtgacggaagaagggattgagtaccagtggggc
aacaacccgccggtccgcctatgggcgcaactgacgaccgagggcaaaccccatggctggccacatgaaatcatt
cagtactattatggactataccccgccgccaccattgccgcagtatccggggcgagtctgatggccctcctaact
ctagcggccacatgctgcatgctggccaccgcgaggagaaagtgcctaacaccatacgccttgacgccaggagcg
gtggtaccgttgacactggggctgctttgctgcgcaccgagggcgaacgcagcatcattcgctgagactatggca
tatctgtgggacgagaacaaaaccctcttttggatggaattcgcggccccagccgcagcgcttgctttgctggca
tgctgtatcaaaagcctgatctgctgttgtaagccatttttctttttttagtgttactgagcctgggagcctccgca
aaagcttacgagcacacagccacaattccgaatgtggtggggttcccgtataaggctcacattgaaaggaatggc
ttctcgcccatgactctgcagcttgaagtggtggagacaagcttggaacccacacttaacctggagtacattacc
tgcgaatacaagacggtggtcccttcgccattcatcaaatgttgcggaacatcagaatgctcatccaaggagcag
ccagactaccaatgcaaggtgtacacgggtgtatacccattcatgtggggtggagcctactgtttctgcgactcc
gagaacacgcagctcagcgaggcctatgtcgacaggtcagacgtttgcaaacatgatcacgcatcggcctacaag
gcacacacggcctctctaaaagcaacaatcaggatcagttatggcaccatcaaccagaccaccgaggccttcgtt
aatggtgaacacgcggtcaacgtgggcggaagcaagttcatctttggaccgatctcaacagcttggtcaccgttc
gacaataaaattgtcgtgtataaagatgatgtctacaaccaggacttcccaccctacggatcaggccagccgggt
agattcggagacattcagagcaggacagtggagagcaaagacttgtatgccaacacggccctaaaactctcaaga
ccatcacccggggttgtgcatgtgccatacacgcagacaccatccggatttaaatattggctgaaggagaaagga
tcttcattgaatacaaaggcccctttggctgcaagataaagaccaatccagtcagagccatggattgtgcagtt
ggcagtatacctgtgtcgatggacatacctgacagtgcattcacacgagtggtagatgccccggctgtaacagac
ctgagctgccaggtagtggtctgtacacactcctccgatttcggaggagttgccacattgtcttacaaaacggac
aaacccggcaagtgcgctgtccactcacattccaacgtcgcaacgttgcaagaggcgacggtggatgtcaaggag
gatggcaaggtcacagtgcactttccacggcgtccgcctccccggccttcaaagtgtccgtctgtgacgcaaaa
acaacgtgcacggcggcgtgcgagcctccaaaagaccacatcgtcccttatggggcgagccataacaaccaggtc
tttccggacatgtcaggaactgcgatgacgtgggtgcagaggctggccagtgggttaggtgggctggctctcatc
gcggtggttgtgctggtcttggtaacctgcataacaatgcgtcggtaaggatccagatctgctgtgccttctagt
tgccagccatctgttgtttgcccctcccccgtgccttccttgaccctggaaggtgccactcccactgtcctttcc
taataaaatgaggaaattgcatcgcattgtctgagtaggtgtcattctattctggggggtggggtgggcaggac
agcaaggggggaggattgggaagacaatagcaggcatgctggggatgcggtgggctctatgggtacccacgtgctg
aagaattgacccggttcctcctgggccagaaagaagcaggcacatccccttctctgtgacacaccctgtccacgc
ccctggttcttagttccagccccactcataggacactcatagctcaggagggctccgccttcaatcccacccgct

Figure 55C continued aaagtacttggagcggtctctccctccctcatcagcccaccaaaccaaacctagcctccaagagtgggaagaaat
taaagcaagataggctattaagtgcagagggagagaaaatgcctccaacatgtgaggaagtaatgagagaaatca
tagaattttaaggccatgatttaaggccatcatggccttaatcttccgcttcctcgctcactgactcgctgcgct
cggtcgttcggctgcggcgagcggtatcagctcactcaaaggcggtaatacggttatccacagaatcaggggata
acgcaggaaagaacatgtgagcaaaaggccagcaaaaggccaggaaccgtaaaaaggccgcgttgctggcgtttt
tccataggctccgcccccctgacgagcatcacaaaaatcgacgctcaagtcagaggtggcgaaacccgacaggac
tataaagataccaggcgtttccccctggaagctccctcgtgcgctctcctgttccgaccctgccgcttaccggat
acctgtccgcctttctcccttcgggaagcgtggcgctttctcatagctcacgctgtaggtatctcagttcggtgt
aggtcgttcgctccaagctgggctgtgtgcacgaaccccccgttcagcccgaccgctgcgccttatccggtaact
atcgtcttgagtccaacccggtaagacacgacttatcgccactggcagcagccactggtaacaggattagcagag
cgaggtatgtaggcggtgctacagagttcttgaagtggtggcctaactacggctacactagaagaacagtatttg
gtatctgcgctctgctgaagccagttaccttcggaaaaagagttggtagctcttgatccggcaaacaaaccaccg
ctggtagcggtggtttttttgtttgcaagcagcagattacgcgcagaaaaaaaggatctcaagaagatcctttga
tcttttctacggggtctgacgctcagtggaacgaaaactcacgttaagggattttggtcatgagattatcaaaaa
ggatcttcacctagatccttttaaattaaaaatgaagttttaaatcaatctaaagtatatatgagtaaacttggt
ctgacagttaccaatgcttaatcagtgaggcacctatctcagcgatctgtctatttcgttcatccatagttgcct
gactcgggggggggggcgctgaggtctgcctcgtgaagaaggtgttgctgactcataccaggcctgaatcgccc
catcatccagccagaaagtgagggagccacggttgatgagagctttgttgtaggtggaccagttggtgattttga
acttttgctttgccacggaacggtctgcgttgtcgggaagatgcgtgatctgatccttcaactcagcaaaagttc
gatttattcaacaaagccgccgtcccgtcaagtcagcgtaatgctctgccagtgttacaaccaattaaccaattc
tgattagaaaaactcatcgagcatcaaatgaaactgcaatttattcatatcaggattatcaataccatatttttg
aaaaagccgtttctgtaatgaaggagaaaactcaccgaggcagttccataggatggcaagatcctggtatcggtc
tgcgattccgactcgtccaacatcaatacaacctattaatttcccctcgtcaaaaataaggttatcaagtgagaa
atcaccatgagtgacgactgaatccggtgagaatggcaaaagcttatgcatttctttccagacttgttcaacagg
ccagccattacgctcgtcatcaaaatcactcgcatcaaccaaaccgttattcattcgtgattgcgcctgagcgag
acgaaatacgcgatcgctgttaaaaggacaattacaaacaggaatcgaatgcaaccggcgcaggaacactgccag
cgcatcaacaatattttcacctgaatcaggatattcttctaatacctggaatgctgttttcccggggatcgcagt
ggtgagtaaccatgcatcatcaggagtacggataaaatgcttgatggtcggaagaggcataaattccgtcagcca
gtttagtctgaccatctcatctgtaacatcattggcaacgctacctttgccatgtttcagaaacaactctggcgc
atcgggcttcccatacaatcgatagattgtcgcacctgattgcccgacattatcgcgagcccatttatacccata
taaatcagcatccatgttggaatttaatcgcggcctcgagcaagacgtttcccgttgaatatggctcataacacc
ccttgtattactgtttatgtaagcagacagttttattgttcatgatgatatatttttatcttgtgcaatgtaaca
tcagagattttgagacacaacgtggctttcccccccccccccattattgaagcatttatcagggttattgtctcat
gagcggatacatatttgaatgtatttagaaaaataaacaaataggggttccgcgcacatttccccgaaaagtgcc
acctgacgtctaagaaaccattattatcatgacattaacctataaaaataggcgtatcacgaggccctttcgtc

Figure 55D

Amino acid sequence mnyiptqtfygrrwrprpafrpwqvpmqptptmvtpmlqapdlqaqqmqqlisavsalttkqnvkapkgqnnnkq
qkpkekkenqkkkptqkkkqqqkpkpqakkkkpgrrermcmkiendcifevkldgkvtgyaclvgdkvmkpahvk
gtidnpdlakltykksskydlecaqipvhmksdaskythekpeghynwhhgavqysggrftiptgagkpgdsgrp
ifdnkgrvvaivlgganegartalsvvtwtkdmvtrvtpegteewsaalmmcilantsfpcssppcypccyekqp
eqtlrmlednvnrpgyyelleasmtcrnrsrhrrsvtehfnvykatrpylaycadcgdgyfcyspvaiekirdea
sdgmlkiqvsaqigldkagthahtkirymaghdvqeskrdslrvytsaacsihgtmghfivahcppgdylkvsfe
dadshvkackvqykhdplpvgrekfvvrphfgvelpctsyqlttaptdeeidmhtppdipdrtllsqtagnvkit
aggrtirynctcgrdnvgttstdktintckidqchaavtshdkwqftspfvpradqtarrgkvhvpfpltnvtcr
vplarapdvtygkkevtlrlhpdhptlfsyrslgaephpyeewvdkfseriipvteegieyqwgnnppvrlwaql
ttegkphgwpheiiqyyyglypaatiaavsgaslmalltlaatccmlatarrkcltpyaltpgavvpltlgllcc
apranaasfaetmaylwdenktlfwmefaapaaalallaccikslicccckpfsflvllslgasakayehtatipn
vvgfpykahierngfspmtlqlevvetsleptlnleyitceyktvvpspfikccgtsecsskeqpdyqckvytgv
ypfmwggaycfcdsentqlseayvdrsdvckhdhasaykahtaslkatirisygtinqtteafvngehavnvggs
kfifgpistawspfdnkivvykddvynqdfppygsgqpgrfgdiqsrtveskdlyantalklsrpspgvvhvpyt
qtpsgfkywlkekgsslntkapfgckiktnpvramdcavgsipvsmdipdsaftrvvdapavtdlscqvvvcths
sdfggvatlsyktdkpgkcavhshsnvatlqeatvdvkedgkvtvhfstasaspafkvsvcdakttctaaceppk
dhivpygashnnqvfpdmsgtamtwvqrlasglgglaliavvvlvlvtcitmrr

Figure 56A

CMV/R Ross River Virus T48 capsid R71N K72N K73N K74N

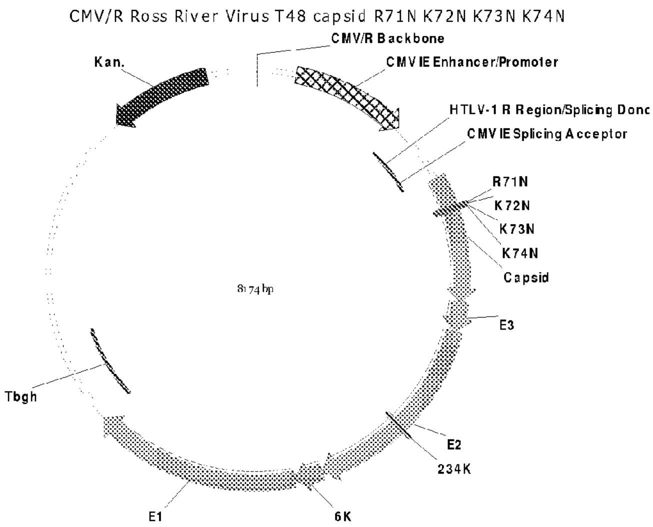

Figure 56B
Insert sequence of capsid atgaattacataccaacccagactttttacggacgccgttggcggcctcgcccggcgttccgtccatggcaggtg
ccgatgcagccgacacctactatggttacacccatgctgcaagcaccagacctacaggcccaacagatgcaacaa
ctgatcagcgctgtctctgcattaaccaccaaacagaatgtaaaagcaccaaaagggcaaaataacaataatcag
cagaaaccaaaggaaaagaaggaaaaccagaagaaaaagccgacgcaaaagaagaagcagcagcagaaaccaaaa
ccacaggctaagaagaagaaaccagggagaagagaaagaatgtgcatgaagatcgagaatgactgcatattcgag
gtcaaactggatggcaaggttaccggttatgcgtgcctagtcggagacaaggtcatgaagccggctcacgttaaa
ggcacaattgataacccagaccttgcgaagctgacttacaagaaatccagtaagtatgacctcgaatgcgcccag
ataccagtgcacatgaagtccgacgcctccaagtacacacatgaaaaacccgaaggtcattacaattggcaccat
ggagcagtgcagtacagcggaggaaggtttaccatccccacaggcgccggcaaaccgggagatagcggtaggcct
atttttgacaacaaagggcgagtagtggccatcgtgttaggcggggccaacgaaggtgctcgcactgcgctgtct
gtggtgacgtggacaaaagacatggtcactcgggtaacgccagaaggaactgaagagtgg Figure 56C
Full sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc

Figure 56C continued aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatatcgcggccgctctagacaccatgaattacataccaacccagacttttacggacgccgttgg
cggcctcgcccggcgttccgtccatggcaggtgccgatgcagccgacacctactatggttacacccatgctgcaa
gcaccagacctacaggcccaacagatgcaacaactgatcagcgctgtctctgcattaaccaccaaacagaatgta
aaagcaccaaaagggcaaaataacaataatcagcagaaaccaaaggaaaacaaggaaaaccagaagaaaaagccg
acgcaaaagaagaagcagcagcagaaaccaaaaccacaggctaagaagaacaaaccagggagaagagaaagaatg
tgcatgaagatcgagaatgactgcatattcgaggtcaaactggatggcaaggttaccggttatgcgtgcctagtc
ggagacaaggtcatgaagccggctcacgttaaaggcacaattgataacccagaccttgcgaagctgacttacaag
aaatccagtaagtatgacctcgaatgcgcccagataccagtgcacatgaagtccgacgcctccaagtacacacat
gaaaaacccgaaggtcattacaattggcaccatggagcagtgcagtacagcggaggaaggtttaccatccccaca
ggcgccggcaaaccgggagatagcggtaggcctattttgacaacaaagggcgagtagtggccatcgtgttaggc
ggggccaacgaaggtgctcgcactgcgctgtctgtggtgacgtggacaaaagacatggtcactcgggtaacgcca
gaaggaactgaagagtggtctgccgcgctgatgatgtgtatccttgccaacacctctttcccctgctcatcacct
ccctgctacccctgctgctacgaaaaacagccagaacagacactgcggatgctggaagacaatgtgaatagacca
gggtactatgagctactggaagcgtccatgacatgcagaaacagatcacgccaccgccgtagtgtaacagagcac
ttcaatgtgtataaggctactagaccgtacttagcgtattgcgctgactgtggggacgggtacttctgctatagc
ccagttgctatcgagaagatccgagatgaggcgtctgacggcatgctcaagatccaagtctccgcccaaataggt
ctggacaaggcaggtacccacgcccacacgaagatccgatatatggctggtcatgatgttcaggaatctaagaga
gattccttgagggtgtacacgtccgcagcgtgctctatacatgggacgatggacacttcatcgtcgcacattgt
ccgccaggcgactacctcaaggtttcgttcgaggacgcagattcacacgtgaaggcatgtaaggtccaatacaag
cacgacccattgccggtgggtagagagaagttcgtggttagaccccactttggcgtagagctgccatgcacctca
taccagctgacaacagctcccaccgacgaggagatcgacatgcacacaccgccagatataccggatcgcaccctg
ctatcacagacggcgggcaacgtcaaaataacagcaggcggcaggactatcaggtacaattgtacctgtggccgt
gacaacgtaggcactaccagtactgacaagaccatcaacacatgcaagattgaccaatgccatgctgccgttacc
agccatgacaaatggcaatttacctctccatttgttcccagggctgatcagacagctaggagggggcaaagtgcat
gttccattccctttgactaacgtcacctgccgagtgccgttggctcgagcgccggatgtcacctatggtaagaag
gaggtgaccctgagattacacccagatcatccgacgctcttctcctataggagtttaggagccgaaccgcacccg
tacgaggagtgggttgacaagttctctgagcgcatcatcccagtgacggaagaagggattgagtaccagtggggc
aacaacccgccggtccgcctatgggcgcaactgacgaccgagggcaaaccccatggctggccacatgaaatcatt
cagtactattatggactataccccgccgccaccattgccgcagtatccggggcgagtctgatggccctcctaact
ctagcggccacatgctgcatgctggccaccgcgaggagaaagtgcctaacaccatacgccttgacgccaggagcg
gtggtaccgttgacactggggctgctttgctgcgcaccgagggcgaacgcagcatcattcgctgagactatggca
tatctgtgggacgagaacaaaaccctcttttggatggaattcgcggccccagccgcagcgcttgctttgctggca
tgctgtatcaaaagcctgatctgctgttgtaagccatttctttttttagtgttactgagcctgggagcctccgca
aaagcttacgagcacacagccacaattccgaatgtggtggggttcccgtataaggctcacattgaaaggaatggc
ttctcgcccatgactctgcagcttgaagtggtggagacaagcttggaacccacacttaacctggagtacattacc
tgcgaatacaagacggtggtcccttcgccattcatcaaatgttgcggaacatcagaatgctcatccaaggagcag
ccagactaccaatgcaaggtgtacacgggtgtatacccattcatgtggggtggagcctactgtttctgcgactcc
gagaacacgcagctcagcgaggcctatgtcgacaggtcagacgtttgcaaacatgatcacgcatcggcctacaag
gcacacacggcctctctaaaagcaacaatcaggatcagttatggcaccatcaaccagaccaccgaggccttcgtt
aatggtgaacacgcggtcaacgtgggcggaagcaagttcatctttggaccgatctcaacagcttggtcaccgttc
gacaataaaattgtcgtgtataaagatgatgtctacaaccaggacttcccaccctacggatcaggccagccgggt
agattcggagacattcagagcaggacagtggagagcaaagacttgtatgccaacacggccctaaaactctcaaga
ccatcacccggggttgtgcatgtgccatacacgcagacaccatccggatttaaatattggctgaaggagaaagga
tcttcattgaatacaaaggccccttttggctgcaagataaagaccaatccagtcagagccatggattgtgcagtt
ggcagtatacctgtgtcgatggacatacctgacagtgcattcacacgagtggtagatgccccggctgtaacagac
ctgagctgccaggtagtggtctgtacacactcctccgatttcggaggagttgccacattgtcttacaaaacggac
aaacccggcaagtgcgctgtccactcacattccaacgtcgcaacgttgcaagaggcgacggtggatgtcaaggag
gatggcaaggtcacagtgcacttttccacggcgtccgcctccccggccttcaaagtgtccgtctgtgacgcaaaa
acaacgtgcacggcggcgtgcgagcctccaaaagaccacatcgtcccttatggggcgagccataacaaccaggtc
tttccggacatgtcaggaactgcgatgacgtgggtgcagaggctggccagtgggttaggtgggctggctctcatc
gcggtggttgtgctggtcttggtaacctgcataacaatgcgtcggtaaggatccagatctgctgtgccttctagt
tgccagccatctgttgtttgcccctcccccgtgccttccttgaccctggaaggtgccactcccactgtcctttcc
taataaaatgaggaaattgcatcgcattgtctgagtaggtgtcattctattctggggggtggggtggggcaggac
agcaagggggaggattgggaagacaatagcaggcatgctggggatgcggtgggctctatgggtacccaggtgctg
aagaattgacccggttcctcctgggccagaaagaagcaggcacatccccttctctgtgacacaccctgtccacgc
ccctggttcttagttccagccccactcataggacactcatagctcaggagggctccgccttcaatcccacccgct
aaagtacttggagcggtctctccctccctcatcagcccaccaaaccaaacctagcctccaagagtgggaagaaat
taaagcaagataggctattaagtgcagagggagagaaaatgcctccaacatgtgaggaagtaatgagagaaatca

Figure 56C continued tagaatttaaggccatgatttaaggccatcatggccttaatcttccgcttcctcgctcactgactcgctgcgct
cggtcgttcggctgcggcgagcggtatcagctcactcaaaggcggtaatacggttatccacagaatcaggggata
acgcaggaaagaacatgtgagcaaaaggccagcaaaaggccaggaaccgtaaaaaggccgcgttgctggcgtttt
tccataggctccgcccccctgacgagcatcacaaaaatcgacgctcaagtcagaggtggcgaaacccgacaggac
tataaagataccaggcgtttccccctggaagctccctcgtgcgctctcctgttccgaccctgccgcttaccggat
acctgtccgcctttctcccttcgggaagcgtggcgctttctcatagctcacgctgtaggtatctcagttcggtgt
aggtcgttcgctccaagctgggctgtgtgcacgaaccccccgttcagcccgaccgctgcgccttatccggtaact
atcgtcttgagtccaacccggtaagacacgacttatcgccactggcagcagccactggtaacaggattagcagag
cgaggtatgtaggcggtgctacagagttcttgaagtggtggcctaactacggctacactagaagaacagtatttg
gtatctgcgctctgctgaagccagttaccttcggaaaaagagttggtagctcttgatccggcaaacaaaccaccg
ctggtagcggtggtttttttgtttgcaagcagcagattacgcgcagaaaaaaaggatctcaagaagatcctttga
tcttttctacggggtctgacgctcagtggaacgaaaactcacgttaagggattttggtcatgagattatcaaaaa
ggatcttcacctagatccttttaaattaaaaatgaagttttaaatcaatctaaagtatatatgagtaaacttggt
ctgacagttaccaatgcttaatcagtgaggcacctatctcagcgatctgtctatttcgttcatccatagttgcct
gactcgggggggggggcgctgaggtctgcctcgtgaagaaggtgttgctgactcataccaggcctgaatcgccc
catcatccagccagaaagtgagggagccacggttgatgagagctttgttgtaggtggaccagttggtgattttga
acttttgctttgccacggaacggtctgcgttgtcgggaagatgcgtgatctgatccttcaactcagcaaaagttc
gatttattcaacaaagccgccgtcccgtcaagtcagcgtaatgctctgccagtgttacaaccaattaaccaattc
tgattagaaaaactcatcgagcatcaaatgaaactgcaatttattcatatcaggattatcaataccatatttttg
aaaaagccgtttctgtaatgaaggagaaaactcaccgaggcagttccataggatggcaagatcctggtatcggtc
tgcgattccgactcgtccaacatcaatacaacctattaatttcccctcgtcaaaaataaggttatcaagtgagaa
atcaccatgagtgacgactgaatccggtgagaatggcaaaagcttatgcatttctttccagacttgttcaacagg
ccagccattacgctcgtcatcaaaatcactcgcatcaaccaaaccgttattcattcgtgattgcgcctgagcgag
acgaaatacgcgatcgctgttaaaaggacaattacaaacaggaatcgaatgcaaccggcgcaggaacactgccag
cgcatcaacaatattttcacctgaatcaggatattcttctaatacctggaatgctgttttcccggggatcgcagt
ggtgagtaaccatgcatcatcaggagtacggataaaatgcttgatggtcggaagaggcataaattccgtcagcca
gtttagtctgaccatctcatctgtaacatcattggcaacgctacctttgccatgtttcagaaacaactctggcgc
atcgggcttcccatacaatcgatagattgtcgcacctgattgcccgacattatcgcgagcccatttatacccata
taaatcagcatccatgttggaatttaatcgcggcctcgagcaagacgtttcccgttgaatatggctcataacacc
ccttgtattactgtttatgtaagcagacagttttattgttcatgatgatatatttttatcttgtgcaatgtaaca
tcagagattttgagacacaacgtggctttcccccccccccattattgaagcatttatcagggttattgtctcat
gagcggatacatatttgaatgtatttagaaaaataaacaaataggggttccgcgcacatttccccgaaaagtgcc
acctgacgtctaagaaaccattattatcatgacattaacctataaaaataggcgtatcacgaggccctttc

Figure 56D

Amino Acid sequence mnyiptqtfygrrwrprpafrpwqvpmqptptmvtpmlqapdlqaqqmqqlisavsalttkqnvkapkgqnnnnq
qkpkekkenqkkkptqkkkqqqkpkpqakkkkpgrrermcmkiendcifevkldgkvtgyaclvgdkvmkpahvk
gtidnpdlakltykksskydlecaqipvhmksdaskythekpeghynwhhgavqysggrftiptgagkpgdsgrp
ifdnkgrvvaivlgganegartalsvvtwtkdmvtrvtpegteewsaalmmcilantsfpcsspcypccyekqp
eqtlrmlednvnrpgyyelleasmtcrnrsrhrrsvtehfnvykatrpylaycadcgdgyfcyspvaiekirdea
sdgmlkiqvsaqigldkagthahtkirymaghdvqeskrdslrvytsaacsihgtmghfivahcppgdylkvsfe
dadshvkackvqykhdplpvgrekfvvrphfgvelpctsyqlttaptdeeidmhtppdipdrtllsqtagnvkit
aggrtirynctcgrdnvgttstdktintckidqchaavtshdkwqftspfvpradqtarrgkvhvpfpltnvtcr
vplarapdvtygkkevtlrlhpdhptlfsyrslgaephpyeewvdkfseriipvteegieyqwgnnppvrlwaql
ttegkphgwpheiiqyyyglypaatiaavsgaslmalltlaatccmlatarrkcltpyaltpgavvpltlgllcc
apranaasfaetmaylwdenktlfwmefaapaaalallaccikslicccckpfsflvllslgasakayehtatipn
vvgfpykahierngfspmtlqlevvetsleptlnleyitceyktvvpspfikccgtsecsskeqpdyqckvytgv
ypfmwggaycfcdsentqlseayvdrsdvckhdhasaykahtaslkatirisygtinqtteafvngehavnvggs
kfifgpistawspfdnkivvykddvynqdfppygsgqpgrfgdiqsrtveskdlyantalklsrpspgvvhvpyt
qtpsgfkywlkekgsslntkapfgckiktnpvramdcavgsipvsmdipdsaftrvvdapavtdlscqvvvcths
sdfggvatlsyktdkpgkcavhshsnvatlqeatvdvkedgkvtvhfstasaspafkvsvcdakttctaaceppk
dhivpygashnnqvfpdmsgtamtwvqrlasglgglaliavvvlvlvtcitmrr Figure 58A
Wild type Barmah Forest Virus (BFV) VLP

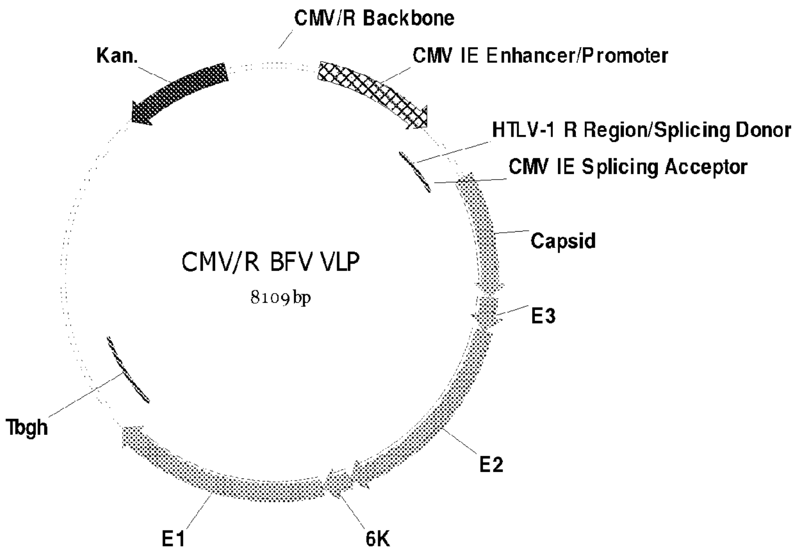

Figure 58B
Sequence of capsid region atggatttcatccccacccaaaccttctatggtagacgatggagaccagcaccagtccagagatacataccccaa
ccccaaccaccagcgcctccacgccgtaggagaggaccatctcaactccaacagcttgtggctgcattgggcgca
ctagctctacaacccaagcagaaacaaaaaagagcacagaagaagcccaagaagacaccaccaccaaaaccaaaa
aagacccagaagcctaagaaaccaacccaaaagaagaagtccaaacccggcaaacgtatgcgtaactgcatgaag
atcgagaatgactgcatctttccggtgatgctcgatggaaaggttaacggctacgcttgcttagtggggataaa
gtcatgaaaccagctcatgtgaagggcacgatcgacaatccagaactagccaaattgacattcaagaaatctagc
aagtatgatctagaatgtgctcaagtgccggtatgcatgaaatcagacgcatccaagttcacccatgagaaacca
gaaggacattacaactggcaccatggggcagtgcaatttagcaatggtaggtttaccattccgacgggctctggc
aaacctggagacagtggtaggcctatttttgacaataccggcaaggtagtagccatagtgctgggaggtgcaaat
gaaggggcccggacagccctatccgtggtcacctggaataaggatatggtgacccgcataacacctgaagaatca
gtggagtgg Figure 58C
Sequence of entire insert atggatttcatccccacccaaaccttctatggtagacgatggagaccagcaccagtccagagatacataccccaa
ccccaaccaccagcgcctccacgccgtaggagaggaccatctcaactccaacagcttgtggctgcattgggcgca
ctagctctacaacccaagcagaaacaaaaaagagcacagaagaagcccaagaagacaccaccaccaaaaccaaaa
aagacccagaagcctaagaaaccaacccaaaagaagaagtccaaacccggcaaacgtatgcgtaactgcatgaag
atcgagaatgactgcatctttccggtgatgctcgatggaaaggttaacggctacgcttgcttagtggggataaa
gtcatgaaaccagctcatgtgaagggcacgatcgacaatccagaactagccaaattgacattcaagaaatctagc
aagtatgatctagaatgtgctcaagtgccggtatgcatgaaatcagacgcatccaagttcacccatgagaaacca
gaaggacattacaactggcaccatggggcagtgcaatttagcaatggtaggtttaccattccgacgggctctggc
aaacctggagacagtggtaggcctatttttgacaataccggcaaggtagtagccatagtgctgggaggtgcaaat
gaaggggcccggacagccctatccgtggtcacctggaataaggatatggtgacccgcataacacctgaagaatca
gtggagtggtcggcggccgcactgnatataacagcactatgtgtcctccagaacttatcgttcccgtgtgatgca
ccaccatgtgcaccatgctgttacgaaaaagaccctgcagggaccctaagattgctgtctgaccactactaccac
cccaagtattatgaattacttgactcgacgatgcactgcccacaaggaaggagacctaagaggtctgttgcgcat

Figure 58C continued ttcgaagcctacaaggctacgagaccgtatatagggtggtgcgcagattgtggactggcaggatcatgcccatcc
cctgtgagcatcgagcacgtctggagtgatgccgacgacggcgtactgaagatccaagtgtccatgcagatcggt
atagctaaaagcaatactattaaccacgctaagatacgttacatgggtgccaatggagtacaggaggctgaacgc
tctaccctaagtgtatccacaacagcaccatgtgacatcttggcgaccatgggccatttcatcttggcccgctgc
cgacccggcagtcaagttgaagtatcactaagcaccgatccaaagctgctatgccgtacaccattctcccacaag
cccaggtttattggcaatgaaaagtccccagcacccaccgggcacaagacccgaattccctgcaaaacttactcc
catcagacagacttaacgagagaagagattacaatgcatgtaccgccggatgtccccatccaagggctagtgtcc
aatacaggtaagtcgtactcattagacccaaagacgaagaccatcaagtacaaatgcacttgcggcgagactgta
aaagaaggtactgctacgaacaaaatcacactgttcaattgtgacaccgccccaaagtgtattacatatgcagtg
gataacacagtgtggcagtacaactcccaatacgtgcccaggtccgaagttacggaggtgaaaggaaagatccat
gtgcctttccctctgaccgacagcacgtgtgcagtcagcgtagcacctgaaccgcaagtgacatacagactgggg
gaagtggagttccacttccaccctatgtaccccaccctcttctccattaggagcctcggaaaggatccgagccac
agtcaagaatggatagatacacccatgagcaagacaatccaagttggggcagaaggcgtggagtatgtctgggga
aacaacaacccggtacgactatgggcacagaagagctcatcgagcagcgcgcatggtaaccctattagcatagtc
tcacattactatgacctgtacccttactggaccatcacagtactagcgagtctaggcttgctaatagtgattagt
tccggtttttcatgctttttgtgttcagtcgctcgaaccaaatgccttacaccctatcaattagcaccaggcgcc
caattacccacatttatagcactcctttgctgcgctaagtctgcacgcgcagacactttagatgatttttcctac
ctgtggaccaacaaccaagccatgttttggctccaactggcatctccggttgcagcgttcttgtgcttatcctat
tgctgtagaaatctagcatgctgtatgaagatttttttagggataagcggcctgtgtgtaattgccacgcaggcc
tacgagcactcaaccacgatgccgaatcaggtgggaataccgtttaaagccttgatagagcgaccaggttacgca
ggcctcccgctatctttagtagtgattaagtcagaattagtcccctcattagttcaggattatattacctgcaac
tacaagactgtggtcccgtctccgtacattaaatgttgcggaggcgctgagtgttcacacaaaaatgaagcggac
tataagtgctcggtgttcacaggcgtgtacccgtttatgtggggaggcgcctactgcttctgtgacaccgaaaac
agtcagatgagtgaagtatacgtaaccagaggagaatcatgcgaggctgaccatgccatcgcttatcaggtacac
acagcatcgcttaaggcacaagtaatgatatcgattggagaactgaaccaaaccgtcgacgtgtttgtcaacgga
gacagtccagccagaatccaacaatcaaagttcatacttgggccgatatccagtgcctggtctcctttttgatcac
aaggtgatcgtatacagggatgaggtgtacaatgaagactacgcaccgtacggatccggccaagcaggcaggttc
ggagacatccaaagtagaactgttaacagcactgatgtctatgccaacaccaatttgaagcttaaaagaccggct
tcaggcaatgttcatgtaccatacacgcaaaccccttcgggtttctcgtactggaaaaaagagaagggagtacca
ttgaatcgaaacgcccctttggctgtatcatcaaagtcaatccagtacgtgctgaaaactgcgtatatggcaac
ataccgatcagtatggatattgcggacgcgcacttcacaaggatcgatgaatccccgtctgtgtccttgaaggcg
tgtgaagtgcagtcctgcacttattcatcggatttggcggagtagcgagcatttcctacacatctaataaggta
ggtaagtgtgccatccacagccactcgaactccgcaacgatgaaggattctgtgcacgatgtccaggaaagcggc
gccttgtcgctttctttgcgacttcctctgtcgagccgaacttcgtggtccaagtgtgtaacgcgcggatcact
tgccatggtaagtgtgaaccaccgaaagaccacatcgtaccatacgcagccaaacacaacgacgccgagtttcca
tccatctctactacagcttggcaatggttggcacacaccacctcagggccactcaccatacttgtggtagctatt
atagtcgttgttgtagtatccattgtagtatgtgcaagacac Figure 58D
Full vector sequence tcgcgcgtttcggtgatgacggtgaaaacctctgacacatgcagctcccggagacggtcacagcttgtctgtaag
cggatgccgggagcagacaagcccgtcagggcgcgtcagcgggtgttggcgggtgtcggggctggcttaactatg
cggcatcagagcagattgtactgagagtgcaccatatgcggtgtgaaataccgcacagatgcgtaaggagaaaat
accgcatcagattggctattggccattgcatacgttgtatccatatcataatatgtacatttatattggctcatg
tccaacattaccgccatgttgacattgattattgactagttattaatagtaatcaattacggggtcattagttca
tagcccatatatggagttccgcgttacataacttacggtaaatggcccgcctggctgaccgcccaacgacccccg
cccattgacgtcaataatgacgtatgttcccatagtaacgccaatagggactttccattgacgtcaatgggtgga
gtatttacggtaaactgcccacttggcagtacatcaagtgtatcatatgccaagtacgccccctattgacgtcaa
tgacggtaaatggcccgcctggcattatgcccagtacatgaccttatgggactttcctacttggcagtacatcta
cgtattagtcatcgctattaccatggtgatgcggttttggcagtacatcaatgggcgtggatagcggtttgactc
acggggatttccaagtctccaccccattgacgtcaatgggagtttgttttggcaccaaaatcaacgggactttcc
aaaatgtcgtaacaactccgccccattgacgcaaatgggcggtaggcgtgtacggtgggaggtctatataagcag
agctcgtttagtgaaccgtcagatcgcctggagacgccatccacgctgttttgacctccatagaagacaccggga
ccgatccagcctccatcggctcgcatctctccttcacgcgcccgccgccctacctgaggccgccatccacgccgg
ttgagtcgcgttctgccgcctcccgcctgtggtgcctcctgaactgcgtccgccgtctaggtaagtttaaagctc
aggtcgagaccgggcctttgtccggcgctcccttggagcctacctagactcagccggctctccacgctttgcctg
accctgcttgctcaactctagttaacggtggagggcagtgtagtctgagcagtactcgttgctgccgcgcgcgcc
accagacataatagctgacagactaacagactgttcctttccatgggtcttttctgcagtcaccgtcgtcgacac
gtgtgatcagatctgcaccatggatttcatccccacccaaaccttctatggtagacgatggagaccagcaccagt

Figure 58D continued ccagagatacataccccaaccccaaccaccagcgcctccacgccgtaggagaggaccatctcaactccaacagct
tgtggctgcattgggcgcactagctctacaacccaagcagaaacaaaaagagcacagaagaagcccaagaagac
accaccaccaaaaccaaaaaagacccagaagcctaagaaaccaacccaaaagaagaagtccaaacccggcaaacg
tatgcgtaactgcatgaagatcgagaatgactgcatctttccggtgatgctcgatggaaaggttaacggctacgc
ttgcttagtggggataaagtcatgaaaccagctcatgtgaagggcacgatcgacaatccagaactagccaaatt
gacattcaagaaatctagcaagtatgatctagaatgtgctcaagtgccggtatgcatgaaatcagacgcatccaa
gttcacccatgagaaaccagaaggacattacaactggcaccatggggcagtgcaatttagcaatggtaggtttac
cattccgacgggctctggcaaacctggagacagtggtaggcctattttgacaataccggcaaggtagtagccat
agtgctgggaggtgcaaatgaagggcccggacagccctatccgtggtcacctggaataaggatatggtgacccg
cataacacctgaagaatcagtggagtggtcggcggccgcactgnatataacagcactatgtgtcctccagaactt
atcgttcccgtgtgatgcaccaccatgtgcaccatgctgttacgaaaaagaccctgcagggaccctaagattgct
gtctgaccactactaccaccccaagtattatgaattacttgactcgacgatgcactgcccacaaggaaggagacc
taagaggtctgttgcgcatttcgaagcctacaaggctacgagaccgtatatagggtggtgcgcagattgtggact
ggcaggatcatgcccatcccctgtgagcatcgagcacgtctggagtgatgccgacgacggcgtactgaagatcca
agtgtccatgcagatcggtatagctaaaagcaatactattaaccacgctaagatacgttacatgggtgccaatgg
agtacaggaggctgaacgctctaccctaagtgtatccacaacagcaccatgtgacatcttggcgaccatggcca
tttcatcttggcccgctgccgacccggcagtcaagttgaagtatcactaagcaccgatccaaagctgctatgccg
tacaccattctcccacaagcccaggtttattggcaatgaaaagtccccagcacccaccgggcacaagacccgaat
tccctgcaaaacttactcccatcagacagacttaacgagagaagagattacaatgcatgtaccgccggatgtccc
catccaagggctagtgtccaatacaggtaagtcgtactcattagacccaaagacgaagaccatcaagtacaaatg
cacttgcggcgagactgtaaaagaaggtactgctacgaacaaaatcacactgttcaattgtgacaccgccccaaa
gtgtattacatatgcagtggataacacagtgtggcagtacaactcccaatacgtgcccaggtccgaagttacgga
ggtgaaaggaaagatccatgtgcctttccctctgaccgacagcacgtgtgcagtcagcgtagcacctgaaccgca
agtgacatacagactgggggaagtggagttccacttccaccctatgtaccccaccctcttctccattaggagcct
cggaaaggatccgagccacagtcaagaatggatagatacacccatgagcaagacaatccaagttggggcagaagg
cgtggagtatgtctggggaaacaacaacccggtacgactatgggcacagaagagctcatcgagcagcgcgcatgg
taaccctattagcatagtctcacattactatgacctgtacccttactggaccatcacagtactagcgagtctagg
cttgctaatagtgattagttccggtttttcatgctttttgtgttcagtcgctcgaaccaaatgccttacacccta
tcaattagcaccaggcgcccaattacccacatttatagcactcctttgctgcgctaagtctgcacgcgcagacac
tttagatgatttttcctacctgtggaccaacaaccaagccatgttttggctccaactggcatctccggttgcagc
gttcttgtgcttatcctattgctgtagaaatctagcatgctgtatgaagatttttttagggataagcggcctgtg
tgtaattgccacgcaggcctacgagcactcaaccacgatgccgaatcaggtgggaataccgtttaaagccttgat
agagcgaccaggttacgcaggcctcccgctatctttagtagtgattaagtcagaattagtcccctcattagttca
ggattatattacctgcaactacaagactgtggtcccgtctccgtacattaaatgttgcggaggcgctgagtgttc
acacaaaaatgaagcggactataagtgctcggtgttcacaggcgtgtacccgtttatgtggggaggcgcctactg
cttctgtgacaccgaaaacagtcagatgagtgaagtatacgtaaccagaggagaatcatgcgaggctgaccatgc
catcgcttatcaggtacacacagcatcgcttaaggcacaagtaatgatatcgattggagaactgaaccaaaccgt
cgacgtgtttgtcaacggagacagtccagccagaatccaacaatcaaagttcatacttgggccgatatccagtgc
ctggtctcctttgatcacaaggtgatcgtatacagggatgaggtgtacaatgaagactacgcaccgtacggatc
cggccaagcaggcaggttcggagacatccaaagtagaactgttaacagcactgatgtctatgccaacaccaattt
gaagcttaaaagaccggcttcaggcaatgttcatgtaccatacacgcaaaccccttcgggtttctcgtactggaa
aaaagagaagggagtaccattgaatcgaaacgccccttttggctgtatcatcaaagtcaatccagtacgtgctga
aaactgcgtatatggcaacataccgatcagtatggatattgcggacgcgcacttcacaaggatcgatgaatcccc
gtctgtgtccttgaaggcgtgtgaagtgcagtcctgcacttattcatcggattttggcggagtagcgagcatttc
ctacacatctaataaggtaggtaagtgtgccatccacagccactcgaactccgcaacgatgaaggattctgtgca
ggatgtccaggaaagcggcgccttgtcgcttttctttgcgacttcctctgtcgagccgaacttcgtggtccaagt
gtgtaacgcgcggatcacttgccatggtaagtgtgaaccaccgaaagaccacatcgtaccatacgcagccaaaca
caacgacgccgagtttccatccatctctactacagcttggcaatggttggcacacaccacctcagggccactcac
catacttgtggtagctattatagtcgttgttgtagtatccattgtagtatgtgcaagacactagagatctgctgt
gccttctagttgccagccatctgttgtttgcccctcccccgtgccttccttgaccctggaaggtgccactcccac
tgtcctttcctaataaaatgaggaaattgcatcgcattgtctgagtaggtgtcattctattctggggggtggggt
ggggcaggacagcaagggggaggattgggaagacaatagcaggcatgctggggatgcggtgggctctatgggtac
ccaggtgctgaagaattgacccggttcctcctgggccagaaagaagcaggcacatccccttctctgtgacacacc
ctgtccacgcccctggttcttagttccagccccactcataggacactcatagctcaggagggctccgccttcaat
cccacccgctaaagtacttggagcggtctctccctccctcatcagcccaccaaaccaaacctagcctccaagagt
gggaagaaattaaagcaagataggctattaagtgcagagggagagaaaatgcctccaacatgtgaggaagtaatg
agagaaatcatagaattttaaggccatgatttaaggccatcatggccttaatcttccgcttcctcgctcactgac
tcgctgcgctcggtcgttcggctgcggcgagcggtatcagctcactcaaaggcggtaatacggttatccacagaa
tcaggggataacgcaggaaagaacatgtgagcaaaaggccagcaaaaggccaggaaccgtaaaaaggccgcgttg
ctggcgtttttccataggctccgcccccctgacgagcatcacaaaaatcgacgctcaagtcagaggtggcgaaac
ccgacaggactataaagataccaggcgtttccccctggaagctccctcgtgcgctctcctgttccgaccctgccg

Figure 58D continued cttaccggatacctgtccgcctttctcccttcgggaagcgtggcgctttctcatagctcacgctgtaggtatctc
agttcggtgtaggtcgttcgctccaagctgggctgtgtgcacgaaccccccgttcagcccgaccgctgcgcctta
tccggtaactatcgtcttgagtccaacccggtaagacacgacttatcgccactggcagcagccactggtaacagg
attagcagagcgaggtatgtaggcggtgctacagagttcttgaagtggtggcctaactacggctacactagaaga
acagtatttggtatctgcgctctgctgaagccagttaccttcggaaaaagagttggtagctcttgatccggcaaa
caaaccaccgctggtagcggtggtttttttgtttgcaagcagcagattacgcgcagaaaaaaaggatctcaagaa
gatcctttgatcttttctacggggtctgacgctcagtggaacgaaaactcacgttaagggattttggtcatgaga
ttatcaaaaaggatcttcacctagatccttttaaattaaaaatgaagttttaaatcaatctaaagtatatatgag
taaacttggtctgacagttaccaatgcttaatcagtgaggcacctatctcagcgatctgtctatttcgttcatcc
atagttgcctgactcgggggggggggggcgctgaggtctgcctcgtgaagaaggtgttgctgactcataccaggcc
tgaatcgccccatcatccagccagaaagtgagggagccacggttgatgagagctttgttgtaggtggaccagttg
gtgattttgaacttttgctttgccacggaacggtctgcgttgtcgggaagatgcgtgatctgatccttcaactca
gcaaaagttcgatttattcaacaaagccgccgtcccgtcaagtcagcgtaatgctctgccagtgttacaaccaat
taaccaattctgattagaaaaactcatcgagcatcaaatgaaactgcaatttattcatatcaggattatcaatac
catatttttgaaaaagccgtttctgtaatgaaggagaaaactcaccgaggcagttccataggatggcaagatcct
ggtatcggtctgcgattccgactcgtccaacatcaatacaacctattaatttcccctcgtcaaaaataaggttat
caagtgagaaatcaccatgagtgacgactgaatccggtgagaatggcaaaagcttatgcatttctttccagactt
gttcaacaggccagccattacgctcgtcatcaaaatcactcgcatcaaccaaaccgttattcattcgtgattgcg
cctgagcgagacgaaatacgcgatcgctgttaaaaggacaattacaaacaggaatcgaatgcaaccggcgcagga
acactgccagcgcatcaacaatattttcacctgaatcaggatattcttctaatacctggaatgctgttttcccgg
ggatcgcagtggtgagtaaccatgcatcatcaggagtacggataaaatgcttgatggtcggaagaggcataaatt
ccgtcagccagtttagtctgaccatctcatctgtaacatcattggcaacgctacctttgccatgtttcagaaaca
actctggcgcatcgggcttcccatacaatcgatagattgtcgcacctgattgcccgacattatcgcgagcccatt
tatacccatataaatcagcatccatgttggaatttaatcgcggcctcgagcaagacgtttcccgttgaatatggc
tcataacaccccttgtattactgtttatgtaagcagacagttttattgttcatgatgatatatttttatcttgtg
caatgtaacatcagagattttgagacacaacgtggctttcccccccccccccattattgaagcatttatcagggtt
attgtctcatgagcggatacatatttgaatgtatttagaaaaataaacaaataggggttccgcgcacatttcccc
gaaaagtgccacctgacgtctaagaaaccattattatcatgacattaacctataaaaataggcgtatcacgaggc
cctttcgtc

Figure 58E

AA sequence of capsid

MDFIPTQTFYGRRWRPAPVQRYIPQPQPPAPPRRRRGPSQLQQLVAALGA
LALQPKQKQKRAQKKPKKTPPPKPKKTQKPKKPTQKKKSKPGKRMRNCMK
IENDCIFPVMLDGKVNGYACLVGDKVMKPAHVKGTIDNPELAKLTFKKSS
KYDLECAQVPVCMKSDASKFTHEKPEGHYNWHHGAVQFSNGRFTIPTGSG
KPGDSGRPIFDNTGKVVAIVLGGANEGARTALSVVTWNKDMVTRITPEES
VEW

Figure 59A

Barmah Forest Virus (BFV) with capsid mutation VLP

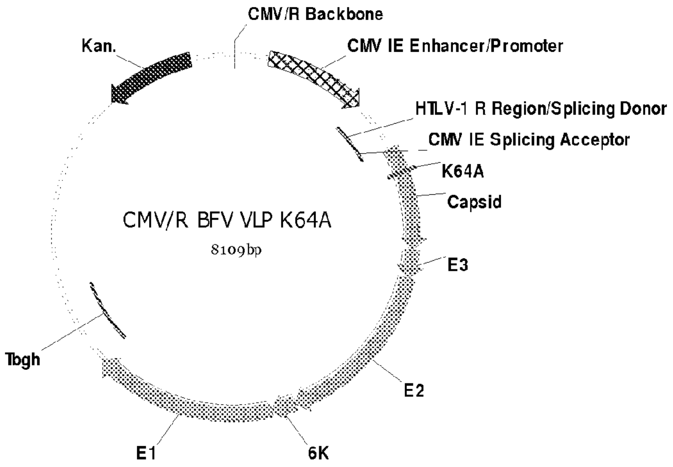

Figure 59B
Sequence of capsid region atggatttcatccccacccaaaccttctatggtagacgatggagaccagcaccagtccagagatacataccccaa
ccccaaccaccagcgcctccacgccgtaggagaggaccatctcaactccaacagcttgtggctgcattgggcgca
ctagctctacaacccaagcagaaacaaaaaagagcacaggcgaagcccaagaagacaccaccaccaaaaccaaaa
aagacccagaagcctaagaaaccaacccaaaagaagaagtccaaacccggcaaacgtatgcgtaactgcatgaag
atcgagaatgactgcatctttccggtgatgctcgatggaaaggttaacggctacgcttgcttagtggggataaa
gtcatgaaaccagctcatgtgaagggcacgatcgacaatccagaactagccaaattgacattcaagaaatctagc
aagtatgatctagaatgtgctcaagtgccggtatgcatgaaatcagacgcatccaagttcacccatgagaaacca
gaaggacattacaactggcaccatggggcagtgcaatttagcaatggtaggtttaccattccgacgggctctggc
aaacctggagacagtggtaggcctatttttgacaataccggcaaggtagtagccatagtgctgggaggtgcaaat
gaaggggcccggacagccctatccgtggtcacctggaataaggatatggtgacccgcataacacctgaagaatca
gtggagtgg Figure 59C
Sequence of entire insert atggatttcatccccacccaaaccttctatggtagacgatggagaccagcaccagtccagagatacataccccaa
ccccaaccaccagcgcctccacgccgtaggagaggaccatctcaactccaacagcttgtggctgcattgggcgca
ctagctctacaacccaagcagaaacaaaaaagagcacaggcgaagcccaagaagacaccaccaccaaaaccaaaa
aagacccagaagcctaagaaaccaacccaaaagaagaagtccaaacccggcaaacgtatgcgtaactgcatgaag
atcgagaatgactgcatctttccggtgatgctcgatggaaaggttaacggctacgcttgcttagtggggataaa
gtcatgaaaccagctcatgtgaagggcacgatcgacaatccagaactagccaaattgacattcaagaaatctagc
aagtatgatctagaatgtgctcaagtgccggtatgcatgaaatcagacgcatccaagttcacccatgagaaacca
gaaggacattacaactggcaccatggggcagtgcaatttagcaatggtaggtttaccattccgacgggctctggc
aaacctggagacagtggtaggcctatttttgacaataccggcaaggtagtagccatagtgctgggaggtgcaaat
gaaggggcccggacagccctatccgtggtcacctggaataaggatatggtgacccgcataacacctgaagaatca
gtggagtggtcggcggccgcactgnatataacagcactatgtgtcctccagaacttatcgttcccgtgtgatgca
ccaccatgtgcaccatgctgttacgaaaaagaccctgcagggaccctaagattgctgtctgaccactactaccac
cccaagtattatgaattacttgactcgacgatgcactgcccacaaggaaggagacctaagaggtctgttgcgcat
ttcgaagcctacaaggctacgagaccgtatatagggtggtgcgcagattgtggactggcaggatcatgcccatcc
cctgtgagcatcgagcacgtctggagtgatgccgacgacggcgtactgaagatccaagtgtccatgcagatcggt
atagctaaaagcaatactattaaccacgctaagatacgttacatgggtgccaatggagtacaggaggctgaacgc
tctaccctaagtgtatccacaacagcaccatgtgacatcttggcgaccatgggccatttcatcttggcccgctgc
cgacccggcagtcaagttgaagtatcactaagcaccgatccaaagctgctatgccgtacaccattctcccacaag
cccaggtttattggcaatgaaaagtccccagcacccaccgggcacaagacccgaattccctgcaaaacttactcc

Figure 59C continued catcagacagacttaacgagagaagagattacaatgcatgtaccgccggatgtccccatccaagggctagtgtcc
aatacaggtaagtcgtactcattagacccaaagacgaagaccatcaagtacaaatgcacttgcggcgagactgta
aaagaaggtactgctacgaacaaaatcacactgttcaattgtgacaccgccccaaagtgtattacatatgcagtg
gataacacagtgtggcagtacaactcccaatacgtgcccaggtccgaagttacggaggtgaaaggaaagatccat
gtgcctttccctctgaccgacagcacgtgtgcagtcagcgtagcacctgaaccgcaagtgacatacagactgggg
gaagtggagttccacttccaccctatgtaccccaccctcttctccattaggagcctcggaaaggatccgagccac
agtcaagaatggatagatacacccatgagcaagacaatccaagttggggcagaaggcgtggagtatgtctgggga
aacaacaacccggtacgactatgggcacagaagagctcatcgagcagcgcgcatggtaaccctattagcatagtc
tcacattactatgacctgtacccttactggaccatcacagtactagcgagtctaggcttgctaatagtgattagt
tccggtttttcatgctttttgtgttcagtcgctcgaaccaaatgccttacaccctatcaattagcaccaggcgcc
caattacccacatttatagcactcctttgctgcgctaagtctgcacgcgcagacactttagatgatttttcctac
ctgtggaccaacaaccaagccatgttttggctccaactggcatctccggttgcagcgttcttgtgcttatcctat
tgctgtagaaatctagcatgctgtatgaagatttttttagggataagcggcctgtgtgtaattgccacgcaggcc
tacgagcactcaaccacgatgccgaatcaggtgggaataccgtttaaagccttgatagagcgaccaggttacgca
ggcctcccgctatctttagtagtgattaagtcagaattagtcccctcattagttcaggattatattacctgcaac
tacaagactgtggtcccgtctccgtacattaaatgttgcggaggcgctgagtgttcacacaaaaatgaagcggac
tataagtgctcggtgttcacaggcgtgtacccgtttatgtggggaggcgcctactgcttctgtgacaccgaaaac
agtcagatgagtgaagtatacgtaaccagaggagaatcatgcgaggctgaccatgccatcgcttatcaggtacac
acagcatcgcttaaggcacaagtaatgatatcgattggagaactgaaccaaaccgtcgacgtgtttgtcaacgga
gacagtccagccagaatccaacaatcaaagttcatacttgggccgatatccagtgcctggtctccttttgatcac
aaggtgatcgtatacagggatgaggtgtacaatgaagactacgcaccgtacggatccggccaagcaggcaggttc
ggagacatccaaagtagaactgttaacagcactgatgtctatgccaacaccaatttgaagcttaaaagaccggct
tcaggcaatgttcatgtaccatacacgcaaaccccttcgggtttctcgtactggaaaaagagaagggagtacca
ttgaatcgaaacgcccctttggctgtatcatcaaagtcaatccagtacgtgctgaaaactgcgtatatggcaac
ataccgatcagtatggatattgcggacgcgcacttcacaaggatcgatgaatccccgtctgtgtccttgaaggcg
tgtgaagtgcagtcctgcacttattcatcggattttggcggagtagcgagcatttcctacacatctaataaggta
ggtaagtgtgccatccacagccactcgaactccgcaacgatgaaggattctgtgcaggatgtccaggaaagcggc
gccttgtcgctttctttgcgacttcctctgtcgagccgaacttcgtggtccaagtgtgtaacgcgcggatcact
tgccatggtaagtgtgaaccaccgaaagaccacatcgtaccatacgcagccaaacacaacgacgccgagtttcca
tccatctctactacagcttggcaatggttggcacacaccacctcagggccactcaccatacttgtggtagctatt
atagtcgttgttgtagtatccattgtagtatgtgcaagacac

Figure 59D

Sequence of entire vector cctatccgtggtcacctggaataaggatatggtgacccgcataacacctgaagaatcagtggagtggtcggcggc
cgcactgnatataacagcactatgtgtcctccagaacttatcgttcccgtgtgatgcaccaccatgtgcaccatg
ctgttacgaaaaagaccctgcagggaccctaagattgctgtctgaccactactaccaccccaagtattatgaatt
acttgactcgacgatgcactgcccacaaggaaggagacctaagaggtctgttgcgcatttcgaagcctacaaggc
tacgagaccgtatatagggtggtgcgcagattgtggactggcaggatcatgcccatcccctgtgagcatcgagca
cgtctggagtgatgccgacgacggcgtactgaagatccaagtgtccatgcagatcggtatagctaaaagcaatac
tattaaccacgctaagatacgttacatgggtgccaatggagtacaggaggctgaacgctctaccctaagtgtatc
cacaacagcaccatgtgacatcttggcgaccatgggccatttcatcttggcccgctgccgacccggcagtcaagt
tgaagtatcactaagcaccgatccaaagctgctatgccgtacaccattctcccacaagcccaggtttattggcaa
tgaaaagtccccagcacccaccgggcacaagacccgaattccctgcaaaacttactcccatcagacagacttaac
gagagaagagattacaatgcatgtaccgccggatgtccccatccaagggctagtgtccaatacaggtaagtcgta
ctcattagacccaaagacgaagaccatcaagtacaaatgcacttgcggcgagactgtaaaagaaggtactgctac
gaacaaaatcacactgttcaattgtgacaccgccccaaagtgtattacatatgcagtggataacacagtgtggca
gtacaactcccaatacgtgcccaggtccgaagttacggaggtgaaaggaaagatccatgtgcctttccctctgac
cgacagcacgtgtgcagtcagcgtagcacctgaaccgcaagtgacatacagactgggggaagtggagttccactt
ccaccctatgtaccccaccctcttctccattaggagcctcggaaaggatccgagccacagtcaagaatggataga
tacacccatgagcaagacaatccaagttggggcagaaggcgtggagtatgtctggggaaacaacaacccggtacg
actatgggcacagaagagctcatcgagcagcgcgcatggtaaccctattagcatagtctcacattactatgacct
gtacccttactggaccatcacagtactagcgagtctaggcttgctaatagtgattagttccggtttttcatgctt
tttgtgttcagtcgctcgaaccaaatgccttacaccctatcaattagcaccaggcgcccaattacccacatttat
agcactcctttgctgcgctaagtctgcacgcgcagacactttagatgatttttcctacctgtggaccaacaacca
agccatgttttggctccaactggcatctccggttgcagcgttcttgtgcttatcctattgctgtagaaatctagc
atgctgtatgaagatttttttagggataagcggcctgtgtgtaattgccacgcaggcctacgagcactcaaccac
gatgccgaatcaggtgggaataccgtttaaagccttgatagagcgaccaggttacgcaggcctcccgctatcttt
agtagtgattaagtcagaattagtcccctcattagttcaggattatattacctgcaactacaagactgtggtccc
gtctccgtacattaaatgttgcggaggcgctgagtgttcacacaaaaatgaagcggactataagtgctcggtgtt

Figure 59D continued cacaggcgtgtacccgtttatgtgggaggcgcctactgcttctgtgacaccgaaaacagtcagatgagtgaagt
atacgtaaccagaggagaatcatgcgaggctgaccatgccatcgcttatcaggtacacacagcatcgcttaaggc
acaagtaatgatatcgattggagaactgaaccaaaccgtcgacgtgtttgtcaacggagacagtccagccagaat
ccaacaatcaaagttcatacttggccgatatccagtgcctggtctcctttgatcacaaggtgatcgtatacag
ggatgaggtgtacaatgaagactacgcaccgtacggatccggccaagcaggcaggttcggagacatccaaagtag
aactgttaacagcactgatgtctatgccaacaccaatttgaagcttaaaagaccggcttcaggcaatgttcatgt
accatacacgcaaaccccttcggtttctcgtactggaaaaagagaagggagtaccattgaatcgaaacgcccc
ttttggctgtatcatcaaagtcaatccagtacgtgctgaaaactgcgtatatggcaacataccgatcagtatgga
tattgcggacgcgcacttcacaaggatcgatgaatccccgtctgtgtccttgaaggcgtgtgaagtgcagtcctg
cacttattcatcggatttggcggagtagcgagcatttcctacacatctaataaggtaggtaagtgtgccatcca
cagccactcgaactccgcaacgatgaaggattctgtgcaggatgtccaggaaagcggcgccttgtcgcttttctt
tgcgacttcctctgtcgagccgaacttcgtggtccaagtgtgtaacgcgcggatcacttgccatggtaagtgtga
accaccgaaagaccacatcgtaccatacgcagccaaacacaacgacgccgagtttccatccatctctactacagc
ttggcaatggttggcacacaccacctcagggccactcaccatacttgtggtagctattatagtcgttgttgtagt
atccattgtagtatgtgcaagacactagagatctgctgtgccttctagttgccagccatctgttgtttgcccctc
ccccgtgccttccttgaccctggaaggtgccactcccactgtcctttcctaataaaatgaggaaattgcatcgca
ttgtctgagtaggtgtcattctattctggggggtggggtggggcaggacagcaaggggaggattgggaagacaa
tagcaggcatgctggggatgcggtgggctctatgggtacccaggtgctgaagaattgacccggttcctcctgggc
cagaaagaagcaggcacatccccttctctgtgacacaccctgtccacgcccctggttcttagttccagccccact
cataggacactcatagctcaggagggctccgccttcaatcccacccgctaaagtacttggagcggtctctccctc
cctcatcagcccaccaaaccaaacctagcctccaagagtgggaagaaattaaagcaagataggctattaagtgca
gagggagagaaaatgcctccaacatgtgaggaagtaatgagagaaatcatagaattttaaggccatgatttaagg
ccatcatggccttaatcttccgcttcctcgctcactgactcgctgcgctcggtcgttcggctgcggcgagcggta
tcagctcactcaaaggcggtaatacggttatccacagaatcaggggataacgcaggaaagaacatgtgagcaaaa
ggccagcaaaaggccaggaaccgtaaaaaggccgcgttgctggcgtttttccataggctccgcccccctgacgag
catcacaaaaatcgacgctcaagtcagaggtggcgaaacccgacaggactataaagataccaggcgtttccccct
ggaagctccctcgtgcgctctcctgttccgaccctgccgcttaccggatacctgtccgcctttctcccttcggga
agcgtggcgctttctcatagctcacgctgtaggtatctcagttcggtgtaggtcgttcgctccaagctgggctgt
gtgcacgaaccccccgttcagcccgaccgctgcgccttatccggtaactatcgtcttgagtccaacccggtaaga
cacgacttatcgccactggcagcagccactggtaacaggattagcagagcgaggtatgtaggcggtgctacagag
ttcttgaagtggtggcctaactacggctacactagaagaacagtatttggtatctgcgctctgctgaagccagtt
accttcggaaaaagagttggtagctcttgatccggcaaacaaaccaccgctggtagcggtggtttttttgtttgc
aagcagcagattacgcgcagaaaaaaaggatctcaagaagatcctttgatcttttctacggggtctgacgctcag
tggaacgaaaactcacgttaagggattttggtcatgagattatcaaaaaggatcttcacctagatccttttaaat
taaaaatgaagttttaaatcaatctaaagtatatatgagtaaacttggtctgacagttaccaatgcttaatcagt
gaggcacctatctcagcgatctgtctatttcgttcatccatagttgcctgactcgggggggggggcgctgaggt
ctgcctcgtgaagaaggtgttgctgactcataccaggcctgaatcgccccatcatccagccagaaagtgagggag
ccacggttgatgagagctttgttgtaggtggaccagttggtgattttgaacttttgctttgccacggaacggtct
gcgttgtcgggaagatgcgtgatctgatccttcaactcagcaaaagttcgatttattcaacaaagccgccgtccc
gtcaagtcagcgtaatgctctgccagtgttacaaccaattaaccaattctgattagaaaaactcatcgagcatca
aatgaaactgcaatttattcatatcaggattatcaataccatatttttgaaaaagccgtttctgtaatgaaggag
aaaactcaccgaggcagttccataggatggcaagatcctggtatcggtctgcgattccgactcgtccaacatcaa
tacaacctattaatttcccctcgtcaaaaataaggttatcaagtgagaaatcaccatgagtgacgactgaatccg
gtgagaatggcaaaagcttatgcatttctttccagacttgttcaacaggccagccattacgctcgtcatcaaaat
cactcgcatcaaccaaaccgttattcattcgtgattgcgcctgagcgagacgaaatacgcgatcgctgttaaaag
gacaattacaaacaggaatcgaatgcaaccggcgcaggaacactgccagcgcatcaacaatattttcacctgaat
caggatattcttctaatacctggaatgctgttttcccggggatcgcagtggtgagtaaccatgcatcatcaggag
tacggataaaatgcttgatggtcggaagaggcataaattccgtcagccagtttagtctgaccatctcatctgtaa
catcattggcaacgctacctttgccatgtttcagaaacaactctggcgcatcgggcttcccatacaatcgataga
ttgtcgcacctgattgcccgacattatcgcgagcccatttatacccatataaatcagcatccatgttggaattta
atcgcggcctcgagcaagacgtttcccgttgaatatggctcataacaccccttgtattactgtttatgtaagcag
acagttttattgttcatgatgatatatttttatcttgtgcaatgtaacatcagagattttgagacacaacgtggc
tttccccccccccccattattgaagcatttatcagggttattgtctcatgagcggatacatatttgaatgtattt
agaaaaataaacaaataggggttccgcgcacatttccccgaaaagtgccacctgacgtctaagaaaccattatta
tcatgacattaacctataaaaataggcgtatcacgaggccctttcgtctcgcgcgtttcggtgatgacggtgaaa
acctctgacacatgcagctcccggagacggtcacagcttgtctgtaagcggatgccgggagcagacaagcccgtc
agggcgcgtcagcgggtgttggcgggtgtcggggctggcttaactatgcggcatcagagcagattgtactgagag
tgcaccatatgcggtgtgaaataccgcacagatgcgtaaggagaaaataccgcatcagattggctattggccatt
gcatacgttgtatccatatcataatatgtacatttatattggctcatgtccaacattaccgccatgttgacattg
attattgactagttattaatagtaatcaattacggggtcattagttcatagcccatatatggagttccgcgttac
ataacttacggtaaatggcccgcctggctgaccgcccaacgacccccgcccattgacgtcaataatgacgtatgt

Figure 59D continued tcccatagtaacgccaatagggactttccattgacgtcaatgggtggagtatttacggtaaactgcccacttggc
agtacatcaagtgtatcatatgccaagtacgccccctattgacgtcaatgacggtaaatggcccgcctggcatta
tgcccagtacatgaccttatgggactttcctacttggcagtacatctacgtattagtcatcgctattaccatggt
gatgcggttttggcagtacatcaatgggcgtggatagcggtttgactcacggggatttccaagtctccaccccat
tgacgtcaatgggagtttgttttggcaccaaaatcaacgggactttccaaaatgtcgtaacaactccgccccatt
gacgcaaatgggcggtaggcgtgtacggtgggaggtctatataagcagagctcgtttagtgaaccgtcagatcgc
ctggagacgccatccacgctgttttgacctccatagaagacaccgggaccgatccagcctccatcggctcgcatc
tctccttcacgcgcccgccgccctacctgaggccgccatccacgccggttgagtcgcgttctgccgcctcccgcc
tgtggtgcctcctgaactgcgtccgccgtctaggtaagtttaaagctcaggtcgagaccgggcctttgtccggcg
ctcccttggagcctacctagactcagccggctctccacgctttgcctgaccctgcttgctcaactctagttaacg
gtggagggcagtgtagtctgagcagtactcgttgctgccgcgcgcgccaccagacataatagctgacagactaac
agactgttcctttccatgggtcttttctgcagtcaccgtcgtcgacacgtgtgatcagatctgcaccatggattt
catccccacccaaaccttctatggtagacgatggagaccagcaccagtccagagatacataccccaaccccaacc
accagcgcctccacgccgtaggagaggaccatctcaactccaacagcttgtggctgcattgggcgcactagctct
acaacccaagcagaaacaaaaaagagcacaggcgaagcccaagaagacaccaccaccaaaaccaaaaaagaccca
gaagcctaagaaaccaacccaaaagaagaagtccaaacccggcaaacgtatgcgtaactgcatgaagatcgagaa
tgactgcatctttccggtgatgctcgatggaaaggttaacggctacgcttgcttagtggggataaagtcatgaa
accagctcatgtgaagggcacgatcgacaatccagaactagccaaattgacattcaagaaatctagcaagtatga
tctagaatgtgctcaagtgccggtatgcatgaaatcagacgcatccaagttcacccatgagaaaccagaaggaca
ttacaactggcaccatggggcagtgcaatttagcaatggtaggtttaccattccgacgggctctggcaaacctgg
agacagtggtaggcctatttttgacaataccggcaaggtagtagccatagtgctgggaggtgcaaatgaaggggc
ccggacagc Figure 59E
AA sequence of capsid MDFIPTQTFYGRRWRPAPVQRYIPQPQPPAPPRRRRGPSQLQQLVAALGA
LALQPKQKQKRAQAKPKKTPPPKPKKTQKPKKPTQKKKSKPGKRMRNCMK
IENDCIFPVMLDGKVNGYACLVGDKVMKPAHVKGTIDNPELAKLTFKKSS
KYDLECAQVPVCMKSDASKFTHEKPEGHYNWHHGAVQFSNGRFTIPTGSG
KPGDSGRPIFDNTGKVVAIVLGGANEGARTALSVVTWNKDMVTRITPEES
VEW EEEV VLPs were purified at pH7.9 and yield compared to yields at pH 7.1

Yield of EEEV VLPs is pH dependent

1. EEEV Capsid K67N without changing medium (final pH7.1)
2. Adding Sodium Acetate buffer pH5.5 (1M, final 20mM and pH6.9)
3. Adding $KH_2PO_4$ buffer pH6.2 (1M, final 20mM and pH6.7)
4. Adding HEPES buffer pH7.5 (1M, final 20mM and pH7.26)
5. Adding Tris-HCl buffer pH8.0 (1M, final 20mM and pH7.5)
6. Adding Tris-HCl buffer pH7.5 (1M, final 20mM and pH7.2)
7. Adding Tris-HCl buffer pH8.8 (2M, final 20mM and pH8.0)

Addition of Tris-HCl buffer 24 after transfection of EEEV 67N

Figure 63
A
Adding Tris-HCl buffer to maintain higher pH
24h after transfection of CHIKV OPY-1
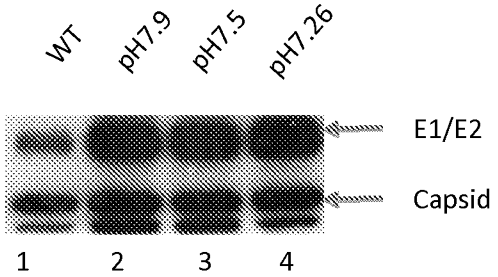
1. CHIKV OPY-1 without changing medium (final pH7.1)
2. Adding Tris-HCl buffer pH8.8 (2M, final 20mM and pH7.9)
3. Adding Tris-HCl buffer pH8.0 (1M, final 20mM and pH7.5)
4. Adding Tris-HCl buffer pH7.5 (1M, final 20mM and pH7.2)
B
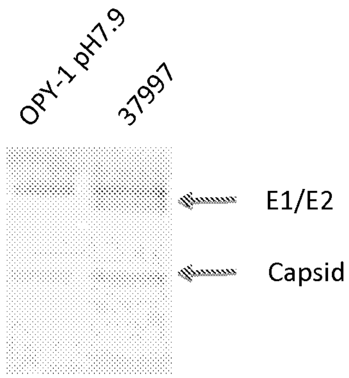

Adding mutation to the pH sensitive ASR region of CHIKV OPY-1

3 and 4 days after transfection mutations are expressed at similar levels but WT CHIKV OPY-1 is almost gone

VIRUS-LIKE PARTICLES AND METHODS OF USE

CROSS-REFERENCE TO RELATED APPLICATIONS

This application is a national stage application under 35 U.S.C. 371 of PCT Patent Application No. PCT/US12/23361 having an international filing date of 31 Jan. 2012, which designated the United States; which PCT application claims the benefit of the following U.S. Provisional Application Nos. 61/438,236, filed Jan. 31, 2011, and 61/501,012, filed Jun. 24, 2011, each of which is incorporated herein by reference in its entirety.

STATEMENT OF RIGHTS TO INVENTIONS MADE UNDER FEDERALLY SPONSORED RESEARCH

Research supporting this application was carried out by the United States of America as represented by the Secretary, Department of Health and Human Services. This research was supported by the Intramural Research Program, Vaccine Research Center, NIAID of the National Institute of Health. The Government has certain rights in this invention.

REFERENCE TO SEQUENCE LISTING

This application contains a Sequence Listing submitted as an electronic text file named "6137NIAID-31-PUS_sequence_listing_ST25.txt", having a size of 860 KB and created on Feb. 24, 2014. The information contained in this electronic file is hereby incorporated by reference in its entirety pursuant to 37 CFR §1.52(e)(5).

BACKGROUND OF THE INVENTION

Alphaviruses comprise a set of genetically, structurally, and serologically related mosquito-borne viruses of the Togaviridae family. Twenty-seven known viruses and virus subtypes have been classified within the alphavirus genus, eleven of which are recognized to be pathogenic to humans. Eastern equine encephalitis virus (EEEV), Western equine encephalitis virus (WEEV), Venezuelan equine encephalitis virus (VEEV), and Semliki Forest virus (SFV) are known to produce encephalitis, and infection by Chikungunya virus (CHIKV), O'nyong-nyong virus, Sindbis virus, Mayaro virus, Ross River virus, Barmah Forest virus, and Ockelbo virus result in acute onset of flu-like fever, followed by the development of a rash and arthritis. The evolution and spread of alphaviruses into new geographic areas, and the disease severity resulting from alphavirus infection present a serious public health issue in the absence of a vaccines or anti-viral therapies.

Flaviviruses comprise a set of genetically, structurally, and serologically related mosquito-borne or tick-borne viruses of the Flaviviridae family that also pose current or potential threats to global public health. Yellow Fever Virus (YFV), Dengue Virus (DENV), Japanese Encephalitis Virus (JEV), Tick-Borne Encephalitis Virus (TBEV), and West Nile Virus (WNV) result in a range of symptoms ranging from flu-like symptoms such as fever, chills, and vomiting to severe symptoms such as muscular rigidity, photophobia, hyperexcitability, abnormal tremors and movements, incoordination, paralysis, sensory loss, convulsions, respiratory dysfunction, and severe hemorrhages. Like other arthropod-borne viruses, the evolution and spread of flaviruses into new geographic areas, and the disease severity resulting from flavivirus infection present a serious public health issue in the absence of a vaccines or anti-viral therapies.

SUMMARY OF THE INVENTION

The present invention features compositions and methods for the prevention or treatment of a disease or disorder mediated by an alphavirus or a flavivirus (e.g., Chikungunya virus, WEEV, EEEV, VEEV, Ross River virus, or Barmah Forest virus).

Expression of alphavirus structural proteins, such as CHIKV, WEEV, EEEV, VEEV, Ross River virus, or Barmah Forest virus structural proteins, gives rise to virus-like particles (VLPs) that resemble replication-competent alphavirus. In some cases, expression of wild-type alphavirus proteins does not produce VLPs, such as EEEV and WEEV CBA, and one or more alterations in one or more of an alphavirus E2 protein or an alphavirus capsid protein Nuclear Localization Signal (NLS) allows or enhances VLP production. As reported in detail below, an alphavirus VLP-based vaccine efficiently induced high-titer neutralizing antibodies against homologous and heterologous alphavirus strains in monkeys, and the immunized animals showed complete protection against a high titer of a heterologous alphavirus strain in a challenge study. Because VLP vaccines are known to have advantages such as safety and high immunogenicity, it is desirable to use VLPs and a VLP vaccine strategy against pathogenic alphaviruses. In addition, based on the ability of VLPs to bind and deliver agents to a cell, it is desirable to produce alphavirus VLPs for delivering target agents to cells.

Similarly, expression of flavivirus structural proteins gives rise to VLPs that resemble replication-competent flavivirus. Therefore, it is desirable to use VLPs and a VLP vaccine strategy against pathogenic flaviviruses. In addition, based on the ability of VLPs to bind and deliver agents to a cell, it is desirable to produce flavivirus VLPs for delivering target agents to cells.

Accordingly, the invention provides virus-like particles (VLP) having one or more alterations that enhance or allow VLP production, where the alteration is in one or more of an E2 protein or an alphavirus capsid protein Nuclear Localization Signal (NLS).

In one aspect, the invention generally provides a virus-like particle (VLP) containing an alphavirus E2 protein containing at least one alteration that enhances VLP production, where the alteration is at an amino acid position corresponding to amino acid 234 or amino acid 251 in a Chikungunya virus (CHIKV) E2 protein.

In another aspect, the invention provides a VLP containing a Chikungunya virus (CHIKV) E2 protein containing an alteration at amino acid 234 and/or at amino acid 251.

In yet another aspect, the invention provides a VLP containing a WEEV E2 protein, where the WEEV E2 protein has an alteration at amino acid position 235.

In still another aspect, the invention provides a virus-like particle (VLP) containing a flavivirus envelop protein containing an alteration at an amino acid position corresponding to amino acid 234 or amino acid 251 in a Chikungunya virus (CHIKV) E2 protein.

In one aspect, the invention provides a virus-like particle (VLP) having one or more alterations that enhance or allow VLP production, wherein the alteration is in an alphavirus capsid protein Nuclear Localization Signal (NLS).

In still another aspect, the invention provides an isolated polynucleotide encoding a VLP of a previous aspect or that is delineated herein.

In still another aspect, the invention provides an expression vector containing an isolated polynucleotide encoding a VLP of a previous aspect or that is delineated herein. In one embodiment, the expression vector is capable of expression in a prokaryotic or eukaryotic cell. In another embodiment, the vector contains the CMV/R promoter.

In still another aspect, the invention provides a prokaryotic or eukaryotic cell containing the expression vector of any previous aspect or a vector that is described herein.

In still another aspect, the invention provides an immunogenic composition containing an effective amount of the VLP of any previous aspect or that is delineated herein or an effective amount of the expression vector of any previous aspect, where administration of the immunogenic composition to a subject results in production of a VLP. In one embodiment, the VLP induces an immune response in the subject. In another embodiment, the immune response treats or prevents a virus infection in the subject. In yet another embodiment, the VLP induces antibodies against homologous or heterologous strains of alphavirus or flavivirus. In one embodiment, the immunogenic composition further contains an adjuvant.

In another aspect, the invention provides an immunogenic composition or pan-alphavirus immunogenic composition containing at least two VLPs that are any one or more of Eastern equine encephalitis virus (EEEV), Western equine encephalitis virus (WEEV), Venezuelan equine encephalitis virus (VEEV), Chikungunya virus (CHIKV), Ross River virus, Barmah Forest virus (BFV), Semliki Forest virus (SFV), O'nyong-nyong virus, Sindbis virus, Mayaro virus, or Ockelbo virus. In various embodiments of the above aspects or any other aspect of the invention delineated herein, VLPs have one or more alterations that enhance VLP production, where the alteration is in an E2 protein or an alphavirus capsid protein Nuclear Localization Signal (NLS).

In another aspect, the invention provides an immunogenic composition containing at least two VLPs that are any one or more of a Yellow Fever Virus (YFV), Dengue Virus (DENV), Japanese Encephalitis Virus (JEV), Tick-Borne Encephalitis Virus (TBEV), or West Nile Virus (WNV) protein.

In another aspect, the invention provides an method of inducing an immune response against a virus, including one or more of EEEV, WEEV, VEEV, CHIKV Ross River virus, or Barmah Forest virus, in a subject, involving administering to the subject an effective amount of the immunogenic composition of any previous aspect or any other aspect of the invention delineated herein. In one embodiment, the method induces neutralizing antibodies in the subject. In one embodiment, the method protects the subject against infection by the alphavirus and/or protects the subject against viremia or an inflammatory consequence of infection with said virus.

In another aspect, the invention provides a vaccine containing an effective amount of a VLP of any previous aspect or any other aspect of the invention delineated herein.

In another aspect, the invention provides a vaccine containing a polynucleotide encoding the VLP of any previous aspect or any other VLP delineated herein. In one embodiment, the vaccine is a DNA vaccine.

In another aspect, the invention provides a method for treating or preventing a virus infection in a subject, involving administering to the subject an effective amount of the immunogenic composition of any previous aspect. In one embodiment, the vaccine or immunogenic composition is administered in one or more doses. In another embodiment, the vaccine or immunogenic composition is administered in one or more priming immunizations and one or more boosting immunizations. In yet another embodiment, the priming immunizations are administered at one, two, three, four, five, six, seven, or eight week intervals. In still another embodiment, the boosting immunizations are administered two weeks, one month, two months, or three months after the priming immunization. In yet another embodiment, the administration of the vaccine or immunogenic composition protects the subject against viremia or the inflammatory consequences of an alphavirus or flavivirus infection. In one embodiment, the administration of the vaccine or immunogenic composition protects the subject from lethality.

In another aspect, the invention provides a method for producing a VLP, the method involving expressing one or more of an alphavirus E2 protein having an alteration or an alphavirus capsid protein having an alteration in an NLS in a eukaryotic cell, and isolating said VLP.

In another aspect, the invention provides a method for producing a VLP, the method involving expressing an alphavirus structural protein in a cell, thereby resulting in self-assembly of the VLP, where the cell expresses an alphavirus E2 protein that has i) an asparagine residue at the amino acid position corresponding to amino acid 234 in a CHIKV E2 protein, or ii) a modification at the amino acid position corresponding to amino acid 251 in the CHIKV E2 protein, and where the modification destabilizes the alphavirus E2 protein during VLP budding. In one embodiment, the cell further expresses an alphavirus capsid (C) or an alphavirus envelope protein that is any one or more of E3, 6K, and E1. In another embodiment, the cell expresses an alphavirus polyprotein containing C-E3-E2-6K-E1. In yet another embodiment, the alphavirus envelope protein(s) or the alphavirus capsid protein is derived from EEEV, WEEV, VEEV, CHIKV, Ross River virus, Barmah Forest virus, SFV, O'nyong-nyong virus, Sindbis virus, Mayaro virus, or Ockelbo virus.

In another aspect, the invention provides a method for producing a VLP involving expressing an alphavirus capsid protein comprising an alteration in an NLS in a eukaryotic cell, and isolating said VLP.

In another aspect, the invention provides a method for enhancing VLP production, involving expressing an alphavirus structural protein of any previous aspect or any other aspect of the invention delineated herein in a cell under conditions that provide for self-assembly of the VLP.

In another aspect, the invention provides a method for producing a VLP, where the method involves expressing a flavivirus structural protein in a cell, thereby resulting in self-assembly of the VLP, where the cell expresses a flavivirus envelope protein that has i) an asparagine residue at the amino acid position corresponding to amino acid 234 in a CHIKV E2 protein, or ii) a modification at the amino acid position corresponding to amino acid 251 in the CHIKV E2 protein, and where the modification destabilizes the flavivirus envelope protein during VLP budding. In one embodiment, the cell further expresses a flavivirus capsid protein. In another embodiment, the flavivirus envelope protein or flavivirus capsid protein is derived from YFV, DENV, JEV, TBEV, or WNV.

In another aspect, the invention provides a method for enhancing VLP production in a cell involving altering an amino acid residue in an alphavirus E2 protein that corresponds to amino acid 234 and/or amino acid 251 in a CHIKV E2 protein; and expressing the alphavirus E2 protein in a cell; thereby resulting in self-assembly of the VLP. In one embodiment, the method further involves expressing an alphavirus capsid (C) or an alphavirus envelope protein that is any one or more of E3, 6K, and E1 in the cell. In another embodiment, the method involves expressing an alphavirus polyprotein containing C-E3-E2-6K-E1 in the cell. In another embodiment, the alphavirus E2 protein contains an asparagine residue at the amino acid position corresponding to amino acid 234 in the CHIKV E2 protein. In another embodiment, the alphavirus E2 protein is altered at the amino acid position corresponding to amino acid 251 in the CHIKV E2 protein such that the alteration destabilizes the alphavirus E2 protein during VLP budding.

In another aspect, the invention provides a method for enhancing VLP production in a cell involving altering an amino acid residue in a flavivirus envelope protein that corresponds to amino acid 234 and/or amino acid 251 in a CHIKV E2 protein; and expressing the flavivirus envelope protein in a cell; thereby resulting in self-assembly of the VLP. In one embodiment, the method further contains expressing an flavivirus capsid protein in the cell. In another embodiment, the flavivirus envelope protein is altered such that it has an asparagine residue at the amino acid position corresponding to amino acid 234 in the CHIKV E2 protein. In still another embodiment, the flavivirus envelope protein is altered at the amino acid position corresponding to amino acid 251 in the CHIKV E2 protein such that the alteration destabilizes the flavivirus envelope protein during VLP budding. In another embodiment, the method further involves isolating the VLP.

In another aspect, the invention provides a VLP produced by the method of any above aspect or any other method described herein.

In another aspect, the invention provides a kit containing the VLP of any previous aspect, and directions for the use of said VLP or expression vector to generate an immune response in a subject.

In yet another aspect, the invention provides a method for introducing an agent into a cell involving packaging the agent into the VLP of any previous aspect, contacting a cell with the packed VLP; and allowing the packed VLP to enter the cell, thereby introducing the agent into the cell. In one embodiment, the agent is any one or more of a small molecule chemical compound, an antibody, a nucleic acid molecule, a polypeptide, or fragments thereof.

In various embodiments of the above aspects or any other aspect of the invention delineated herein, the VLP further contains an alphavirus (e.g., Eastern equine encephalitis virus (EEEV), Western equine encephalitis virus (WEEV), Venezuelan equine encephalitis virus (VEEV), Semliki Forest virus (SFV), Chikungunya virus (CHIKV), O'nyong-nyong virus, Sindbis virus, Mayaro virus, Ross River virus, Barmah Forest virus, or Ockelbo virus) or flavivirus (e.g., Yellow Fever Virus (YFV), Dengue Virus (DENV), Japanese Encephalitis Virus (JEV), Tick-Borne Encephalitis Virus (TBEV), or West Nile Virus (WNV) protein) capsid (C) protein or an alphavirus envelop protein that is any one or more of E3, 6K, and E1. In other embodiments, the VLP contains an alphavirus polyprotein containing C-E3-E2-6K-E1. In other embodiments, the alphavirus E2 protein or the alphavirus capsid protein is a CHIKV or WEEV protein. In other embodiments, the alphavirus E2 protein(s) or the alphavirus capsid protein is derived from CHIKV strain 37997. In other embodiments, the alphavirus E2 protein(s) or the alphavirus capsid protein is derived from WEEV strain 71V-1658. In other embodiments, the alphavirus E2 protein has an asparagine residue at the amino acid position corresponding to amino acid 234 in the CHIKV E2 protein. In still other embodiments, the alphavirus E2 protein has a modification at the amino acid position corresponding to amino acid 251 in the CHIKV E2 protein that destabilizes the E2 protein during VLP budding. In other embodiments, the alphavirus E2 protein contains alterations at an amino acid corresponding to amino acid 234 and at amino acid 251 in a Chikungunya virus (CHIKV) E2 protein.

In various embodiments of the above aspects or any other aspect of the invention delineated herein, the alphavirus capsid protein is an EEEV, WEEV, VEEV, CHIKV Ross River virus, or Barmah Forest virus capsid protein. In various embodiments of the above aspects or any other aspect of the invention delineated herein, the one or more alterations is in an NLS at amino acids 67-70 of an EEEV capsid protein; at amino acids 67-70 of an WEEV capsid protein; at amino acids 64-68 of an VEEV capsid protein; at amino acids 62-69 of a CHIKV capsid protein; at amino acids 71-74 of a Ross River virus capsid protein; or at amino acids 64-68 of a Barmah Forest virus capsid protein.

In various embodiments of the above aspects or any other aspect of the invention delineated herein, the alteration is a substitution in a charged amino acid of the NLS or basic charged amino acid of the NLS. In some embodiments, the charged amino acid or basic charged amino acid is lysine or arginine. In certain embodiments, the lysine or arginine is substituted with a non-lysine or non-arginine amino acids. In specific embodiments, the lysine or arginine is substituted with asparagine or alanine.

In various embodiments of the above aspects or any other aspect of the invention delineated herein, the EEEV virus capsid protein NLS is altered at amino acid 67. In particular embodiments, the EEEV virus capsid protein NLS has a substitution K67N.

In various embodiments of the above aspects or any other aspect of the invention delineated herein, the WEEV virus capsid protein NLS is altered at one or more of amino acids 67, 68, and 69. In particular embodiments, the WEEV capsid protein NLS comprises K67N, K68N, and/or K69N.

In various embodiments of the above aspects or any other aspect of the invention delineated herein, the VEEV virus capsid protein NLS is altered at one or more of amino acids 64, 65, and 67. In particular embodiments, the VEEV virus capsid protein NLS comprises K64N, K65A or K65N, and/or K67A or K67N.

In various embodiments, the Chikungunya virus capsid protein NLS is altered at one or more of amino acids 62, 63, 65, 66, 68, and 69. In particular embodiments, the Chikungunya virus capsid protein NLS comprises R62A, R63A, R65A, R66A, R68A and/or R69A.

In various embodiments of the above aspects or any other aspect of the invention delineated herein, the Ross River virus capsid protein NLS is altered at one or more of amino acids 71, 72, 73, and 74. In particular embodiments, the Ross River virus capsid protein NLS comprises R71N, R72N, R73N, and/or R74N.

In various embodiments of the above aspects or any other aspect of the invention delineated herein, the Barmah Forest virus capsid protein NLS is altered at one or more of amino acids 64, 65, 67, and 68. In particular embodiments, the Barmah Forest virus capsid protein NLS comprises K64A, K65A or K65N, K67A, K67N, K68A and/or K68N.

In various embodiments of the above aspects or any other aspect of the invention delineated herein, the VLP contains a protein or polynucleotide of interest for delivery to a cell.

In another embodiment, the protein or polynucleotide of interest is derived from a pathogen, including a virus, bacteria, or fungus.

In various embodiments of the above aspects or any other aspect of the invention delineated herein, the expression vector is E37997, EOPY-1, CMV/R WEEV CBA87 strain capsid K67N VLP, CMV/R WEEV CBA87 strain capsid K67N K68N VLP, CMV/R WEEV CBA87 strain capsid K67N K68N K69N VLP, CMV/R VEEV TC83 strain K64N VLP, CMV/R VEEV TC83 strain K64N K65N VLP, CMV/R VEEV TC83 strain K65N K67N VLP, CMV/R VEEV TC83 strain K65A K67A VLP, CMV/R EEEV PE-6 strain capsid K67N VLP, CMV/R EEEV PE-6 strain capsid K67N E2 R239N VLP, CMV/R CHIKV (Strain 37997) Capsid R62A, CMV/R CHIKV (Strain 37997) Capsid R62A R63A, CMV/R CHIKV (Strain 37997) Capsid R62A R63A R65A K66A K68A K69A, CMV/R CHIKV (Strain 37997) Capsid R65A, CMV/R Ross River Virus T48 capsid R71N, CMV/R Ross River Virus T48 capsid R71N K72N, CMV/R Ross River Virus T48 capsid R71N K72N K73N, CMV/R Ross River Virus T48 capsid R71N K72N K73N K74N, or CMV/R BFV VLP K64A.

In various embodiments of the above aspects or any other aspect of the invention delineated herein, the virus-like particle (VLP) or VLP expressing cell is exposed to a high pH condition at least about pH 7.2 (pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher). In various embodiments, exposing VLP to high pH conditions during VLP production (in cell culture, during purification) increases VLP yield.

The invention provides immunogenic compositions featuring VLPs comprising polypeptides (e.g., CHIKV polypeptides, WEEV polypeptides) or polynucleotides for delivery to a mammalian cell. In certain embodiments, the invention provides compositions and methods for the prevention or treatment of CHIKV or WEEV viral disease. The invention also provides immunogenic compositions featuring VLPs comprising flavivirus polypeptides for the prevention or treatment of flavivirus viral disease. Compositions and articles defined by the invention were isolated or otherwise manufactured in connection with the examples provided below. Other features and advantages of the invention will be apparent from the detailed description, and from the claims.

Any compositions or methods provided herein can be combined with one or more of any of the other compositions and methods provided herein. The recitation of an embodiment for any aspect herein includes that embodiment as any single embodiment or in combination with any other embodiments or portions thereof.

DEFINITIONS

By "alphavirus structural protein" is meant a polypeptide or fragment thereof having at least about 80% amino acid sequence identity to a naturally occurring viral capsid or envelope protein and having immunogenic activity in a mammal. In one embodiment, the alphavirus structural protein has at least about 85%, 90%, 95% or greater amino acid sequence identity with a CHIKV, EEEV, WEEV, VEEV, Ross River virus, or Barmah Forest virus structural protein or immunogenic fragment thereof. In one embodiment, the protein exemplary alphaviruses include, but are not limited to, EEEV, WEEV, VEEV, SFV, CHIKV, O'nyong-nyong virus, Sindbis virus, Mayaro virus, Ross River virus, Barmah Forest virus, and Ockelbo virus.

By "flavivirus structural protein" is meant a polypeptide or fragment thereof having at least about 80% amino acid sequence identity to a naturally occurring viral capsid or envelope protein and having immunogenic activity in a mammal. In one embodiment, the flavivirus structural protein has at least about 85%, 90%, 95% or greater amino acid sequence identity with a YFV, DENV, JEV, or TBEV structural protein or immunogenic fragment thereof.

By "agent" is meant any small molecule chemical compound, antibody, nucleic acid molecule, or polypeptide, or fragments thereof.

As used herein, the term "adjuvant" is meant to refer to a compound that, when used in combination with a specific immunogen in a formulation, will augment, alter or modify the resultant immune response. In certain embodiments, the adjuvant is used in combination with a VLP. In other embodiments, the adjuvant is used in combination with a DNA vaccine. Modification of the immune response includes intensification or broadening the specificity of either or both antibody and cellular immune responses. Modification of the immune response can also mean decreasing or suppressing certain antigen-specific immune responses. In one embodiment, the adjuvant is Ribi adjuvant.

As used herein "alphavirus" is meant to refer to RNA-containing viruses that belong to the Flaviviridae family of viruses. Exemplary flaviviruses include but are not limited to EEEV, WEEV, VEEV, SFV, CHIKV, O'nyong-nyong virus, Sindbis virus, Mayaro virus, Ross River virus, Barmah Forest virus, and Ockelbo virus.

As used herein "flavivirus" is meant to refer to RNA-containing viruses that belong to the group Flaviviridae family of viruses. Exemplary flaviviruses include but are not limited to YFV, DENV, JEV, and TBEV.

As used herein "inducing immunity" is meant to refer to any immune response generated against an antigen. In one embodiment, immunity is mediated by antibodies against an infectious agent, which is exhibited by a vertebrate (e.g., a human), that prevents or ameliorates an infection or reduces at least one symptom thereof. VLPs or DNA vaccines of the invention can stimulate the production of antibodies that, for example, neutralize infectious agents, block infectious agents from entering cells, block replication of infectious agents, and/or protect host cells from infection and destruction. The term can also refer to an immune response that is mediated by T-lymphocytes and/or other white blood cells against an infectious agent, exhibited by a vertebrate (e.g., a human), that prevents or ameliorates an infection (e.g., alphavirus or flavivirus) or reduces at least one symptom thereof.

By "ameliorate" is meant decrease, suppress, attenuate, diminish, arrest, or stabilize the development or progression of a disease or a symptom thereof.

By "alteration" is meant a change in an amino acid or nucleotide at a specified position with reference to a polypeptide sequence or polynucleotide sequence. As used herein, an alteration includes a substitution, deletion, or insertion of an amino acid or nucleotide at a specified position of a polypeptide or polynucleotide. In some embodiments, an alteration in an alphavirus capsid protein nuclear localization signal includes substitution of a charged amino acid (e.g., lysine or arginine) with an uncharged amino acid (e.g., alanine or asparagine, or any amino acid except a basic charged amino acid such as lysine or arginine).

By "alteration" is meant a change (increase or decrease) with reference to the expression levels or activity of a gene or polypeptide as detected by standard art known methods, such as those described herein. As used herein, an alteration includes a 10%, 25%, 50%, 75%, 100% or greater change in expression levels. An alteration includes a 10-, 20-, 50-, 70-, 80-, 90-, 100-, 200-, 500-, 1000-fold or greater change in expression levels.

By "analog" is meant a molecule that is not identical, but has analogous functional or structural features. For example, a polypeptide analog retains the biological activity of a corresponding naturally-occurring polypeptide, while having certain biochemical modifications that enhance the analog's function relative to a naturally occurring polypeptide. Such biochemical modifications could increase the analog's protease resistance, membrane permeability, or half-life, without altering, for example, ligand binding. An analog may include an unnatural amino acid.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

"Detect" refers to identifying the presence, absence or amount of the analyte to be detected.

By "disease" is meant any condition or disorder that damages or interferes with the normal function of a cell, tissue, or organ. Examples of diseases include viral infections including but not limited to EEEV, WEEV, VEEV, SFV, CHIKV, O'nyong-nyong virus, Sindbis virus, Mayaro virus, Ross River virus, Barmah Forest virus, Ockelbo virus, YFV, DENV, JEV, and TBEV.

By "effective amount" is meant the amount of an agent required to ameliorate the symptoms of a disease relative to an untreated patient. The effective amount of active compound(s) used to practice the present invention for prevention or treatment of a disease varies depending upon the manner of administration, the age, body weight, and general health of the subject. Ultimately, the attending physician or veterinarian will decide the appropriate amount and dosage regimen. Such amount is referred to as an "effective" amount.

The invention provides a number of targets that are useful for the development of highly specific drugs to treat or prevent a diseases delineated herein. In addition, the methods of the invention provide a facile means to identify therapies that are safe for use in subjects. In addition, the methods of the invention provide a route for analyzing virtually any number of compounds for effects on a disease described herein with high-volume throughput, high sensitivity, and low complexity.

By "fragment" is meant a portion of a polypeptide or nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "high pH" is meant a pH at least about 7.2 or greater (pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher), including basic, alkaline, or non-acidic conditions. In various embodiments, exposing VLP to high pH conditions during VLP production (e.g., in cell culture, during purification) increases VLP yield.

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "isolated polynucleotide" is meant a nucleic acid molecule (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

By "marker" is meant any protein or polynucleotide having an alteration in expression level or activity that is associated with a disease or disorder.

As used herein, "nuclear localization signal" or "NLS" is an amino acid sequence that, when present on the surface of a polypeptide, targets the polypeptide to the nucleus of the cell. NLS sequences are known in the art. See, for example, Goldfarb, D., and N. Michaud (1991) *Trends Cell Biol.* 1, 20-24; Gorlich, D., and I. W. Mattaj (1996) *Science* 271, 1513-1518). In one embodiment, an NLS includes one or more short sequences of positively charged amino acids, such as lysines or arginines. Consensus sequences for NLS include K-K/R-X-K/R (Schneider, J. et al. (1988) *Cell* 54, 117-125) and two clusters of basic amino acids, separated by a spacer of about 10 amino acids, e.g., KR[PAATKKAGQA]KKKK (SEQ ID NO:1) (Dingwall et al., *J Cell Biol.* 107 (3): 841-9). With reference to the alphavirus amino acid sequences of the invention, NLS are present at amino acids 67-70 of an EEEV capsid protein (KRKK) (SEQ ID NO:2); at amino acids 67-70 of an WEEV capsid protein (KKKK) (SEQ ID NO:3); at amino acids 64-68 of a VEEV capsid protein (KKPKK) (SEQ ID NO:4); at amino acids 62-69 of a CHIKV capsid protein (RRNRKNKK) (SEQ ID NO:5); at amino acids 71-74 of a Ross River virus capsid protein (RKKK) (SEQ ID NO:6); and at amino acids 64-68 of a Barmah Forest virus capsid protein (KKPKK) (SEQ ID NO:7).

As used herein, "obtaining" as in "obtaining an agent" includes synthesizing, purchasing, or otherwise acquiring the agent.

By "reduces" is meant a negative alteration of at least 10%, 25%, 50%, 75%, or 100%.

By "reference" is meant a standard or control condition.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, preferably at least about 20 amino acids, more preferably at least about 25 amino acids, and even more preferably about 35 amino acids, about 50 amino acids, or about 100 amino acids. For nucleic acids, the length of the reference nucleic acid sequence will generally be at least about 50 nucleotides, preferably at least about 60 nucleotides, more preferably at least about 75 nucleotides, and even more preferably about 100 nucleotides or about 300 nucleotides or any integer thereabout or therebetween.

By "specifically binds" is meant a compound or antibody that recognizes and binds a polypeptide of the invention, but which does not substantially recognize and bind other molecules in a sample, for example, a biological sample, which naturally includes a polypeptide of the invention.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred: embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 μg/ml denatured salmon sperm DNA (ssDNA). In a most preferred embodiment, hybridization will occur at 42° C. in 250 mM NaCl, 25 mM trisodium citrate, 1% SDS, 50% formamide, and 200 μg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). Preferably, such a sequence is at least 60%, more preferably 80% or 85%, and more preferably 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "structural polyprotein" is meant a composite amino acid molecule comprising at least two separable polypeptides that contribute to a viral capsid or envelope. In one embodiment, the polypeptides are susceptible to cleavage with a viral enzyme (e.g., capsid autoproteinase and signalases).

By "subject" is meant a mammal, including, but not limited to, a human or non-human mammal, such as a bovine, equine, canine, ovine, or feline.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

As used herein, the terms "treat," treating," "treatment," and the like refer to reducing or ameliorating a disorder and/or symptoms associated therewith. It will be appreciated that, although not precluded, treating a disorder or condition does not require that the disorder, condition or symptoms associated therewith be completely eliminated.

As used herein, the term "vaccine" refers to a composition to be used in generating an immune response. In particular embodiments, a vaccine of the invention contains VLPs, DNAs, or other gene-based vaccine vectors in a form that is capable of being administered to a subject and which induces a protective immune response sufficient to induce immunity to prevent and/or ameliorate an infection and/or to reduce at least one symptom of an infection and/or to enhance the efficacy of another dose of VLPs or DNA vaccines. Typically, the vaccine comprises a pharmaceutically acceptable excipient, such as conventional saline or buffered aqueous solution medium in which the composition of the present invention is suspended or dissolved. In this form, the composition of the present invention can be used conveniently to prevent, ameliorate, or otherwise treat an infection. Upon introduction into a host, the vaccine induces an immune response including, but not limited to, the production of antibodies and/or cytokines and/or the activation of cytotoxic T cells, antigen presenting cells, helper T cells, dendritic cells and/or other cellular responses. In certain embodiments, a vaccine can also be a protein. For example, recombinant proteins have been produced by genetically engineering cells to produce one or more foreign genes, which in turn produce proteins that serve as the immunogen.

As used herein, the term "virus-like particle" (VLP) refers to a structure that in at least one attribute resembles a virus, but which has not been demonstrated to be infectious. Virus-like particles in accordance with the invention do not carry genetic information encoding the proteins of the virus-like particles. In general, virus-like particles lack a viral genome and, therefore, are noninfectious. In addition, virus-like particles can often be produced in large quantities by heterologous expression and can be easily purified.

As used herein, the term "virus budding," "virus-like particle budding," or "VLP budding" refers to the process of virion or VLP release from a host cell. This process includes steps associated with maturation, fusion, and cleavage.

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

BRIEF DESCRIPTION OF THE DRAWINGS

FIG. 1A is a schematic representation of the CHIKV genome and CHIKV E expression vector used for incorporation of CHIKV E from strains 37997 and LR2006 OPY-1 into pseudotyped lentiviral vectors. The CHIKV genome consists of nonstructural polyproteins NS1, NS2, NS3 and NS4 and structural polyproteins capsid (C) and envelope (E: E3, E2, 6K and E1) (top). The polypeptide E genes from strains 37997 and LR2006 OPY-1 were inserted into an expression vector (bottom). FIG. 1B includes two graphs. The graph on the left shows the infectivity of the indicated pseudotyped lentiviral vectors in several CHIKV-permissive cell lines, including 293A human renal epithelial, HeLa cervical epithelial, Vero renal epithelial, A549 squamous epithelial and baby hamster kidney (BHK) cells. The pseudotyped vectors were standardized by HIV-1 Gag p24 (left) or the indicated concentration of p24 and used to infect 293A cells (right). After incubation with pseudotyped vectors for 24 hours, cells were lysed and luciferase activity was measured. The experiment was performed in triplicate. FIG. 1C includes two graphs that show the pH-dependent entry of CHIKV pseudotyped lentiviral vectors. Pseudotyped lentiviral vectors were incubated in the presence of the indicated amounts of ammonium chloride (left) and chloroquine (right). The experiment was performed in triplicate. Data are presented as the percentage of activity at the indicated dose relative to activity with no treatment. FIG. 1D is a graph showing neutralization measured with pseudotyped lentiviral vectors in sera from mice injected with CHIKV (strain S-27). Sera were incubated at the indicated dilutions with VSV-G, CHIKV strain 37997 or LR2006 OPY-1 E-pseudotyped lentiviral vectors and the mixture infected to 293A cells. Luciferase activity was analyzed 24 hours after infection. The experiment was performed in triplicate. No inhibition was observed with control non-immune antisera.

FIG. 2A provides a schematic representation of CHIKV C-E or E expression vectors used for DNA vaccine and VLP production. The CHIKV structural polyproteins capsid plus envelope (C-E) or E alone from strains 37997 and LR2006 OPY-1 were inserted into an expression vector. 293T cells were transfected with each of the indicated plasmids. Expression was measured 48 hours after transfection by Western blotting with antisera reactive with CHIKV. FIG. 2B includes a graph, Western blot, and electron micrograph. VLPs were purified from the supernatants of 293F cells transfected with C-E expression vector (C-E37997) (left). The supernatants were harvested 72 hours after transfection followed by OptiPrep density gradient centrifugation. Each fraction was characterized for its buoyant density (left upper panel) and protein content (left lower panel) by Western blot analysis with antisera to CHIKV. The fractionated VLPs were observed by transmission electron microscopy with magnification 20,000× (left, bar 100 nm) (right). FIG. 2C provides a comparison of cryo-EM reconstructions of CHIKV VLP with Sindbis virus showing that CHIKV VLP is structurally similar to alphaviruses. Shaded-surface representation of the 3D density map of CHIKV VLP (left upper panel) and Sindbis virus (right upper panel) viewed along an icosahedral 2-fold axis. The white triangle marks the boundary of an icosahedral asymmetric unit. The numbers show the positions of the icosahedral 2-, 3-, and 5-fold axes limiting an asymmetric unit. The central cross-section through the cryo-EM maps of CHIKV VLP (left lower panel) and Sindbis virus (right lower panel). The orientations of the icosahedral (2-, 3-, and 5-fold) axes as well as the quasi-threefold (q3) axis are shown with white lines. Maps are calculated to 1 8 Å resolution.

FIG. 3C shows results from monkeys immunized with $VLP_{37997}$ or PBS (control) at 0, 4, and 24 weeks. A neutralizing assay was performed with CHIKV strain 37997 (left panel) or LR2006 OPY-1 (right panel) E pseudotyped lentiviral vectors in sera collected from immunized monkeys at 10 days after each immunization. The symbols show the average of the six monkeys and bars show the standard error of the mean. FIG. 3D shows the neutralizing activity against CHIKV LR2006 OPY-1 in immunized monkeys' sera after the 2nd and 3rd immunizations was confirmed by a standard plaque reduction neutralization test (PRNT). The symbols show the average of the six monkeys and bars show the standard error of the mean.

FIG. 4A quantitates results obtained in monkeys injected with PBS (Control) or immunized with $VLP_{37997}$. Monkeys were challenged with $10^{10}$ PFU of the CHIKV strain LR2006 OPY-1 15 weeks after the final boost. The peak viremia at 24 hours after challenge was measured by plaque assay. The serum dilutions started from 1:200 (limit of detection=1000 PFU/ml). Error bars represent the standard error of the mean. FIG. 4B is a graph showing the percentage of monocytes in the monkeys' white blood cells. Monocyte percentage was measured using a hematology analyzer before and 7 days after challenge with CHIKV. Error bars represent the standard error of the mean. A non-parametric two t-test was used for statistical analysis (Control vs. VLPs at 7 days, P=0.0036; Control at 0 days vs. 7 days, P=0.0015; VLPs at 0 days vs. 7 days, P>0.5). FIG. 4C shows the number of viral RNA copies present following passive transfer of purified IgG from a monkey immunized with VLPs (Immune) or a control monkey (Control IgG) into mice (2 mg of total IgG per mouse, n=5 per group). Recipient mice were challenged 24 hours after IgG transfer with a lethal LR2006 OPY-1 challenge (30 PFU) by intradermal injection. The viremia in the mice after challenge was measured by quantitative RT-PCR (limit of detection=40 RNA copies/ml). Error bars represent the standard error of the mean. FIG. 4D shows a survival curve of mice passively transferred with control IgG or CHIKV immunized IgG against lethal LR2006 OPY-1 challenge.

FIG. 6A shows the schematic representation of the CHIKV genome and the chimeric CHIKV C-E expression vector used for VLP production from strains 37997 (blue) and OPY-1 (white). The CHIKV genome consists of the nonstructural polyproteins nsP1, nsP2, nsP3, and nsP4 and the structural polyproteins capsid (C) and envelope (E3, E2, 6K and E1) (top). The schematic representation of chimeric genes from strains 37997 and OPY-1 are shown, 1: $VLP_{OPY\text{-}1}$, 2: $VLP_{C(37997)}$, 3: $VLP_{C\text{-}E3(37997)}$, 4: $VLP_{C\text{-}E2(37997)}$, 5: $VLP_{C\text{-}6K(37997)}$, 6: $VLP_{37997}$, 7: $VLP_{OPY\text{-}1\ E2(37997)}$, 8: $VLP_{OPY\text{-}1\ 5'\text{-}E2(37997)}$ and 9: $VLP_{OPY\text{-}1\ 3'\text{-}E2(37997)}$. FIG. 6B includes a Western blot. 293F cells (Invitrogen, Carlsbad, Calif.) were transfected with each of the indicated plasmids. Expression was measured 72 hours after transfection in the supernatant (top) and cell lysate (bottom) by Western blotting using antisera reactive with CHIKV as a primary antibody and goat anti-mouse immunoglobulins linked to horseradish peroxidase as a secondary antibody. FIG. 6C includes a stain for total protein. VLPs were purified from the supernatants of 293F cells transfected with the indicated plasmids. The supernatants were harvested 72 hours after transfection followed by OptiPrep buoyant density gradient centrifugation to purify VLPs. Coomassie staining analysis was used to characterize VLP fractions.

FIG. 7A depicts the structure of the CHIKV E1/E2 complex (OPY-1 strain). The CHIKV E1/E2 (OPY-1 strain) was modeled from PDB accession number 3N42 and displayed using Pymol. E2 is shown in red and E1 is shown in light blue. The green sphere is the E2 234 position; dark green spheres indicate the differences in amino acids between OPY-1 and 37997 in E2 amino acids 1-290. FIG. 7B identifies the amino acids from the OPY-1 strain that were swapped into the $NH_2$-terminal E2 domain of chimeric $VLP_{OPY\text{-}1\ 5'\text{-}E2\ (37997)}$. The following mutations were created: 1: I32V, 2: S72N, 3: T74M, 4: L84F, 5: T124S, 6: E132D, 7: R140K, 8: A164T, 9: T182S, 10: I222V, 11: N234K, and 12: T284I. 13 is VLPOPY-1 5'-E2 (37997) (wild type). Each of the mutant VLPs were purified from supernatants of 293F cells transfected with the indicated plasmids. The supernatants were harvested 72 hours after transfection followed by OptiPrep density gradient centrifugation. Expression was measured by Western blot using antisera reactive with CHIKV as a primary antibody and goat anti-mouse immunoglobulins linked to horseradish peroxidase as a secondary antibody.

FIG. 8A includes flow cytometry results. Envelope expression on transfected cell membranes was measured by flow cytometry with a CHIKV E1/E2 monoclonal antibody (red line) or a control mouse monoclonal antibody (black line) as a primary antibody and goat anti-mouse immunoglobulins linked to Phycoerythrin as a secondary antibody. FIG. 8B includes a Western blot. The indicated amino acid sequence from the 37997 strain was swapped into the E2 region of $VLP_{OPY\text{-}1}$. The following mutations were transfected into 293F cells. 1: $VLP_{OPY\text{-}1}$, 2: $VLP_{OPY\text{-}1}$ K234N, 3: $VLP_{OPY\text{-}1\ E2(37997)}$, and 4: $VLP_{37997}$. The supernatants were harvested 72 hours after transfection followed by OptiPrep density gradient centrifugation. Expression was measured by Western blot using antisera reactive with CHIKV as a primary antibody and goat anti-mouse immunoglobulins linked to horseradish peroxidase as a secondary antibody. FIG. 8C includes a Western blot. 24 hr after transfection of OPY-1, Tris-HCl buffer was added to change the pH to that indicated (left). 24 hr after transfection of the indicated plasmids, Tris-HCl buffer was added (+) (right). Expression of VLPs in the supernatant 48 hr after transfection was measured by Western blotting, with antisera reactive with CHIKV as a primary antibody and goat anti-mouse immunoglobulins linked to horseradish peroxidase as a secondary antibody. FIG. 8D include structural models showing the form of CHIKV Envelope modified form PDB code 3N42. The E2 a.a. 170, 233, 252 and 256 positions in CHIKV OPY-1 are shown in blue. The E2 a.a. 234 position in CHIKV OPY-1 is shown in white. The E2 domain B is shown in green, the E2 domain A is shown in cyan, the E2 domain C is shown in pink, the E2 β-ribbon connector is shown in purple and the E2 ASR domain in the E2 β-ribbon connector is shown in red. The E1 is shown in yellow. FIG. 8E includes a Western blot. 24 hr after transfection of the indicated plasmids, Tris-HCl buffer was added to change the pH to 7.9 (+). Expression in the supernatant 48 hr after transfection was measured by Western blotting, with antisera reactive with CHIKV as a primary antibody and goat anti-mouse immunoglobulins linked to horseradish peroxidase as a secondary antibody.

FIGS. 9A-9C show the ability of K234N WEEV VLPs on neutralizing antibody production. FIG. 9A includes an amino acid alignment of CHIKV 37997, CHIKV OPY-1, Ross River, Sindbis, WEEV, EEEV, and WEEV E2 regions. The WEEV E2 235 amino acid position corresponding to E2 234 in CHIKV is highlighted in the box. The mutation K235N was swapped into WEEV. FIG. 9A discloses SEQ ID NOS 65-71, respectively, in order of appearance. FIG. 9B includes a Western blot. The wild type $VLP_{WEEV}$ and the mutated plasmid, $VLP_{WEEV\ K235N}$, were transfected into 293F cells. Supernatants were harvested 72 hours after transfection followed by OptiPrep density gradient centrifugation. Expression was measured by Western blot using anti-WEEV antisera as a primary antibody and goat anti-mouse immunoglobulins linked to horseradish peroxidase as a secondary antibody. FIG. 9C includes graphs showing the neutralization titers of sera from BALB/c mice immunized with WEEV 71V-1658 strain (left) or CHIKV LR2006 OPY-1 strain (right) E-pseudotyped lentiviral vectors. Mice were immunized intramuscularly with the indicated amount of VLPs. The experiment was performed in triplicate. The symbols show the average of the five mice, and error bars show the s.e.m. The curve fit was calculated by Prism software.

FIG. 10B shows the sequence of the insert (SEQ ID NO:74). FIG. 10C shows the sequence of the entire plasmid sequence (SEQ ID NO:75).

FIG. 12A shows the CMV/R-Middleburg virus VLP plasmid. FIG. 12B shows the entire plasmid sequence (SEQ ID NO:78).

FIG. 13A shows the CMV/R-Sleeping disease virus VLP plasmid. FIG. 13B shows the entire plasmid sequence (SEQ ID NO:79).

FIG. 14A shows the CMV/R-Getah virus VLP plasmid. FIG. 14B shows the entire plasmid sequence (SEQ ID NO:80).

FIG. 15A shows the CMV/R-Venezuelan equine encephalitis virus VLP plasmid. FIG. 15B shows the entire plasmid sequence (SEQ ID NO:81).

FIG. 16A shows the CMV/R-Western equine encephalitis virus VLP plasmid. FIG. 16B shows the entire plasmid sequence (SEQ ID NO:82).

FIG. 17A shows the CMV/R-Eastern equine encephalitis virus VLP plasmid. FIG. 17B shows the entire plasmid sequence (SEQ ID NO:83).

FIG. 18A shows the CMV/R-Sindbis virus VLP plasmid. FIG. 18B shows the entire plasmid sequence (SEQ ID NO:84).

FIG. 19A shows the CMV/R-Semliki forest virus VLP plasmid. FIG. 19B shows the entire plasmid sequence (SEQ ID NO:85).

FIG. 20A shows the CMV/R-Salmon pancreas disease virus VLP plasmid. FIG. 20B shows the entire plasmid sequence (SEQ ID NO:86).

FIG. 21A shows the CMV/R-Ross River virus VLP plasmid. FIG. 21B shows the entire plasmid sequence (SEQ ID NO:87).

FIG. 22A shows the CMV/R—O'nyong-nyong virus VLP plasmid. FIG. 22B shows the entire plasmid sequence (SEQ ID NO:88).

FIG. 23A shows the CMV/R-Mayaro virus VLP plasmid. FIG. 23B shows the entire plasmid sequence (SEQ ID NO:89).

FIG. 24A shows the CMV/R-Barmah Forest virus VLP plasmid. FIG. 24B shows the entire plasmid sequence (SEQ ID NO:90).

FIG. 25A shows the CMV/R-Aura virus VLP plasmid. FIG. 25B shows the entire plasmid sequence (SEQ ID NO:91).

FIG. 26B shows the CMV/R-CHIKV E3-E2-6K-E1 plasmid (Strain OPY1). FIG. 26C shows the sequence of the insert without the capsid (SEQ ID NO:92).

FIG. 27 shows the sequence of Genbank Accession No. EU224268, which is a Cloning vector pCHIKV-LR ic, complete sequence (SEQ ID NO:93). See, Tsetsarkin, K., Higgs, S., McGee, C. E., De Lamballerie, X., Charrel, R. N. and Vanlandingham, D. L. Infectious clones of Chikungunya virus (La Reunion isolate) for vector competence studies, Vector Borne Zoonotic Dis. 6 (4), 325-337 (2006).

FIG. 28 shows the sequence of Genbank Accession No. EU224270, which is the complete sequence of the Cloning vector pCHIK-37997ic (SEQ ID NO:94).

FIG. 29A shows the CMV/R CHIKV C-E3-E2-6K-E1 (strain OPY1) E2 K234N plasmid. This plasmid contains a CMV/R mammalian expression backbone expressing the following CHIKV OPY1 strain of proteins: capsid, E3, E2, 6K, and E1, with a swap mutation to change expression from amino acid K (lysine) to amino acid N (asparagine) in amino acid 234 of the E2 protein. FIG. 29B shows the entire plasmid sequence (SEQ ID NO:96). FIG. 29B also shows the sequence of the insert (SEQ ID NO:95). FIG. 29C shows the amino acid sequence and map of the CMV/R CHIKV C-E3-E2-6K-E1 (strain OPY1) E2 K234N plasmid (SEQ ID NO:97).

FIG. 30A shows the CMV/R WEEV C-E3-E2-6K-E1 (strain 71V-1658) E2 K235N plasmid. This plasmid contains a CMV/R mammalian expression backbone expressing the following WEEV 71V-1658 strain of proteins: capsid, E3, E2, 6K, and E1, with a swap mutation to change expression from amino acid K (lysine) to amino acid N (asparagine) in amino acid 235 of the E2 protein. FIG. 30B shows the entire plasmid sequence (SEQ ID NO:99). FIG. 30B also shows the sequence of the insert (SEQ ID NO:98). FIG. 30C shows the amino acid sequence and map of the CMV/R WEEV C-E3-E2-6K-E1 (strain 71V-1658) E2 K235N plasmid (SEQ ID NO:100).

FIG. 31A shows the CMV/R-CHIKV C-E3-E2(37997)-6K-E1 (OPY1) plasmid, also known as VLPC-E2(37997). This plasmid contains a CMV/R mammalian expression backbone expressing the 6K and E1 proteins from the CHIKV OPY1 strain, and the capsid, E3, and E2 proteins from the CHIKV 37997 strain. FIG. 31B shows the entire plasmid sequence (SEQ ID NO:102). FIG. 31B also shows the sequence of the insert (SEQ ID NO:101). FIG. 31C shows the amino acid sequence and map of the CMV/R-CHIKV C-E3-E2(37997)-6K-E1 (OPY1) plasmid (SEQ ID NO:103).

FIG. 32A shows the CMV/R-CHIKV C E3 E2 6K(37997)-E1 (OPY1) plasmid, also known as VLPC-6K (37997). This plasmid contains a CMV/R mammalian expression backbone expressing the E1 protein from the CHIKV OPY1 strain, and the capsid, E3, E2, and 6K proteins from the CHIKV 37997 strain. FIG. 32B shows the entire plasmid sequence (SEQ ID NO:105). FIG. 32B also shows the sequence of the insert (SEQ ID NO:104). FIG. 32C shows the amino acid sequence and map of the CMV/R-CHIKV C E3 E2 6K(37997)-E1 (OPY1) plasmid (SEQ ID NO:106).

FIG. 33A shows the CMV/R-CHIKV C-E3-6K-E1 (Strain OPY1)-E2 (strain 37997) plasmid, also known as VLPOPY-1 E2(37997). This plasmid contains a CMV/R mammalian expression backbone expressing the capsid, E3, E1, and 6K proteins from the CHIKV OPY1 strain, and the E2 protein from the CHIKV 37997 strain. FIG. 33B shows the entire plasmid sequence (SEQ ID NO:108). FIG. 33B also shows the sequence of the insert (SEQ ID NO:107). FIG. 33C shows the amino acid sequence and map of the CMV/R-CHIKV C-E3-6K-E1 (Strain OPY1)-E2 (strain 37997) plasmid (SEQ ID NO:109).

FIG. 34A shows the CMV/R-CHIKV C-E3-6K-E2-E1 (Strain OPY1) 5'E2 (strain 37997) plasmid, also known as VLPOPY-1 5'-E2(37997). This plasmid contains a CMV/R mammalian expression backbone expressing the capsid, E3, E2, E1, and 6K proteins from the CHIKV OPY1 strain, and the 5' region of the E2 protein from the CHIKV 37997 strain. FIG. 34B shows the entire plasmid sequence (SEQ ID NO:111). FIG. 34B also shows the sequence of the insert (SEQ ID NO:110). FIG. 34C shows the amino acid sequence and map of the CMV/R-CHIKV C-E3-6K-E2-E1 (Strain OPY1) 5'E2 (strain 37997) plasmid (SEQ ID NO:112).

FIG. 35A depicts a schematic representation of the Eastern Equine Encephalitis (EEEV) C-E expression vector used for VLP production from the PE6 strain. The EEEV capsid protein has a predicted nuclear localization signal (NLS) at amino acid (a.a.) positions 67-70 ("KRKK" disclosed as SEQ ID NO:2). FIG. 35B depicts a Western blot of fractions collected from density gradient centrifugation of EEEV VLPs containing R239N variant EEEV E2 envelope protein and wild-type EEEV capsid protein or R239N variant EEEV E2 envelope protein and K67N variant EEEV capsid protein.

FIG. 36A depicts a schematic representation of the Western Equine Encephalitis Virus (WEEV) capsid-envelope (C-E) expression vector used for VLP production from a CBA strain. The WEEV capsid protein has a predicted nuclear localization signal (NLS) at amino acid (a.a.) positions 67-70 ("KKKK" disclosed as SEQ ID NO:3). FIG. 36A discloses "NKKQ" as SEQ ID NO:72. FIG. 36B depicts a Western blot showing the expression of WEEV VLPs containing wild-type WEEV capsid protein; K67N variant WEEV capsid protein; K67N, K68N variant capsid protein; and K67N, K68N, K69N variant WEEV capsid protein.

FIG. 37A depicts a schematic representation of the Venezuelan Equine Encephalitis Virus (VEEV) C-E expression vector used for VLP production from the T-83 strain. The VEEV capsid protein has a predicted NLS at amino acid positions 64-68 ("KKPKK" disclosed as SEQ ID NO:4). FIG. 37B depicts a Western blot showing the expression of VEEV VLPs containing wild-type VEEV capsid protein; K64N variant VEEV capsid protein; K64N, K65N variant VEEV capsid protein; K65N, K67N variant VEEV capsid protein; K65A, K67A variant VEEV capsid protein; K65A, K67N variant VEEV capsid protein; and K65N, K67A variant VEEV capsid protein.

FIG. 38A depicts a schematic representation of the Venezuelan Equine Encephalitis Virus (VEEV) C-E expression vector used for VLP production from the T-83 strain. The VEEV capsid protein has a predicted NLS at amino acid positions 64-68 ("KKPKK" disclosed as SEQ ID NO:4). FIG. 38B depicts a Western blot of fractions collected from density gradient centrifugation of VEEV VLPs containing wild-type VEEV capsid protein or K64N variant VEEV capsid protein.

FIG. 40A depicts a plasmid map of the CMV/R WEEV CBA87 strain capsid K67N VLP plasmid. FIG. 40B shows the sequence of the insert (SEQ ID NO:113). FIG. 40C shows the sequence of the plasmid (SEQ ID NO:114). FIG. 40D shows the amino acid sequence of the CMV/R WEEV CBA87 strain capsid protein K67N (SEQ ID NO:115).

FIG. 41A depicts a plasmid map of the CMV/R WEEV CBA87 strain capsid K67N K68N VLP plasmid. FIG. 41B shows the sequence of the insert (SEQ ID NO:116). FIG.

41C shows the sequence of the plasmid (SEQ ID NO:117). FIG. 41D shows the amino acid sequence of the CMV/R WEEV CBA87 strain capsid protein K67N K68N (SEQ ID NO:118).

FIG. 42A depicts a plasmid map of the CMV/R WEEV CBA87 strain capsid K67N K68N K69N VLP plasmid. FIG. 42B shows the sequence of the insert (SEQ ID NO:119). FIG. 42C shows the sequence of the plasmid (SEQ ID NO:120). FIG. 42D shows the amino acid sequence of the CMV/R WEEV CBA87 strain capsid protein K67N K68N K69N (SEQ ID NO:121).

FIG. 43A depicts a plasmid map of the CMV/R VEEV TC83 strain K64N VLP plasmid. FIG. 43B shows the sequence of the insert (SEQ ID NO:122). FIG. 43C shows the sequence of the plasmid (SEQ ID NO:123). FIG. 43D shows the amino acid sequence of the VEEV TC83 strain capsid protein K64N (SEQ ID NO:124).

FIG. 44A depicts a plasmid map of the CMV/R VEEV TC83 strain K64N K65N VLP plasmid. FIG. 44B shows the sequence of the insert (SEQ ID NO:125). FIG. 44C shows the sequence of the plasmid (SEQ ID NO:126). FIG. 44D shows the amino acid sequence of the VEEV TC83 strain capsid protein K64N K65N (SEQ ID NO:127).

FIG. 45A depicts a plasmid map of the CMV/R VEEV TC83 strain K65N K67N VLP plasmid. FIG. 45B shows the sequence of the insert (SEQ ID NO:128). FIG. 45C shows the sequence of the plasmid (SEQ ID NO:129). FIG. 45D shows the amino acid sequence of the VEEV TC83 strain capsid protein K65N K67N (SEQ ID NO:130).

FIG. 46A depicts a plasmid map of the CMV/R VEEV TC83 strain K65A K67A VLP plasmid. FIG. 46B shows the sequence of the insert (SEQ ID NO:131). FIG. 46C shows the sequence of the plasmid (SEQ ID NO:132). FIG. 46D shows the amino acid sequence of the VEEV TC83 strain capsid protein K65A K67A (SEQ ID NO:133).

FIG. 47A depicts a plasmid map of the CMV/R EEEV PE-6 strain capsid K67N VLP plasmid. FIG. 47B shows the sequence of the insert (SEQ ID NO:134). FIG. 47C shows the sequence of the plasmid (SEQ ID NO:135). FIG. 47D shows the amino acid sequence of the EEEV PE-6 strain capsid protein K67N (SEQ ID NO:136).

FIG. 48A depicts a plasmid map of the CMV/R EEEV PE-6 strain capsid K67N E2 R239N VLP plasmid. FIG. 48B shows the sequence of the insert (SEQ ID NO:137). FIG. 48C shows the sequence of the plasmid (SEQ ID NO:138). FIG. 48D shows the amino acid sequence of the EEEV PE-6 strain capsid protein K67N (SEQ ID NO:139).

FIG. 49A depicts a plasmid map of the CMV/R CHIKV (Strain 37997) Capsid R62A plasmid. FIG. 49B shows the sequence of the insert (SEQ ID NO:140). FIG. 49C shows the sequence of the plasmid (SEQ ID NO:141). FIG. 49D shows the amino acid sequence of the CHIKV(Strain 37997) Capsid protein R62A (SEQ ID NO:142).

FIG. 50A depicts a plasmid map of the CMV/R CHIKV (Strain 37997) Capsid R62A R63A plasmid. FIG. 50B shows the sequence of the insert (SEQ ID NO:143). FIG. 50C shows the sequence of the plasmid (SEQ ID NO:144). FIG. 50D shows the amino acid sequence of the CHIKV (Strain 37997) Capsid protein R62A R63A (SEQ ID NO:145).

FIG. 51A depicts a plasmid map of the CMV/R CHIKV (Strain 37997) Capsid R62A R63A R65A K66A K68A K69A plasmid. FIG. 51B shows the sequence of the insert (SEQ ID NO:146). FIG. 51C shows the sequence of the plasmid (SEQ ID NO:147). FIG. 51D shows the amino acid sequence of the CHIKV(Strain 37997) Capsid protein R62A R63A R65A K66A K68A K69A (SEQ ID NO:148).

FIG. 52A depicts a plasmid map of the CMV/R CHIKV (Strain 37997) Capsid R65A plasmid. FIG. 52B shows the sequence of the insert (SEQ ID NO:149). FIG. 52C shows the sequence of the plasmid (SEQ ID NO:150). FIG. 52D shows the amino acid sequence of the CHIKV(Strain 37997) Capsid protein R65A (SEQ ID NO:151).

FIG. 53A depicts a plasmid map of the CMV/R Ross River Virus T48 capsid R71N K72N plasmid. FIG. 53B shows the sequence of the insert (SEQ ID NO:152). FIG. 53C shows the sequence of the plasmid (SEQ ID NO:153). FIG. 53D shows the amino acid sequence of the Ross River Virus T48 capsid protein R71N K72N (SEQ ID NO:154).

FIG. 54A depicts a plasmid map of the CMV/R Ross River Virus T48 capsid R71N K72N plasmid. FIG. 54B shows the sequence of the insert (SEQ ID NO:155). FIG. 54C shows the sequence of the plasmid (SEQ ID NO:156). FIG. 54D shows the amino acid sequence of the Ross River Virus T48 capsid protein R71N K72N (SEQ ID NO:157).

FIG. 55A depicts a plasmid map of the CMV/R Ross River Virus T48 capsid R71N K72N K73N plasmid. FIG. 55B shows the sequence of the insert (SEQ ID NO:158). FIG. 55C shows the sequence of the plasmid (SEQ ID NO:159). FIG. 55D shows the amino acid sequence of the Ross River Virus T48 capsid protein R71N K72N K73N (SEQ ID NO:160).

FIG. 56A depicts a plasmid map of the CMV/R Ross River Virus T48 capsid R71N K72N K73N K74N plasmid. FIG. 56B shows the sequence of the insert (SEQ ID NO:161). FIG. 56C shows the sequence of the plasmid (SEQ ID NO:162). FIG. 56D shows the amino acid sequence of the Ross River Virus T48 capsid protein R71N K72N K73N K74N (SEQ ID NO:163).

FIG. 57A shows that VLP yield was significantly increased in high pH buffer. FIG. 57B is a structural determination of the acid sensitive region. FIG. 57C is a Western Blot analysis showing that mutations to the pH sensitive ASR region of CHIKV OPY-1 increase stability of VLPs over 3-4 days, compared to wild-type VLPs.

FIG. 58A shows the CMV/R BFV virus VLP plasmid. FIG. 58B shows the sequence of the capsid region (SEQ ID NO:164). FIG. 58C shows the sequence of the entire insert (SEQ ID NO:165). FIG. 58D shows the sequence of the entire vector (SEQ ID NO:166). FIG. 58E shows the amino acid sequence of the CMV/R BFV capsid protein (SEQ ID NO:167).

FIG. 59A shows the CMV/R BFV capsid K64A VLP plasmid. FIG. 59B shows the sequence of the BFV K64A capsid region (SEQ ID NO:168). FIG. 59C shows the sequence of the entire insert (SEQ ID NO:169). FIG. 59D shows the sequence of the entire vector (SEQ ID NO:170). FIG. 59E shows the amino acid sequence of the BFV capsid K64A capsid protein (SEQ ID NO:171).

FIGS. 63A and 63B show that addition of Tris-HCl buffer 24 hr after transfection increased CHIKV OPY-1 yield by Western Blot analysis and SDS-PAGE analysis, respectively.

FIG. 65A are Western Blots showing the expression of WEEV and VEEV VLPs containing NLS signal mutations and the purification of EEEV VLP with the K67N mutation compared to that of wild-type EEEV VLP. FIG. 65B are Western Blots showing that NLS signal mutations in combination with high pH conditions increase EEEV and VEEV production. FIG. 65B discloses SEQ ID NOS 3, 2, 4, and 73, respectively, in order of appearance.

FIG. 66A is a graph showing that mice vaccinated with multivalent VLPs showed high levels of neutralizing antibodies against all the viruses. FIG. 66B is a graph showing that high viremia was observed in the control, VEEV VLP and EEEV VLP groups but not in the WEEV VLPs and the trivalent groups. FIG. 66C is a graph showing that mice immunized with WEEV VLPs controlled the challenge virus, while all control mice developed severe infections and died.

DETAILED DESCRIPTION OF THE INVENTION

Figure 1:
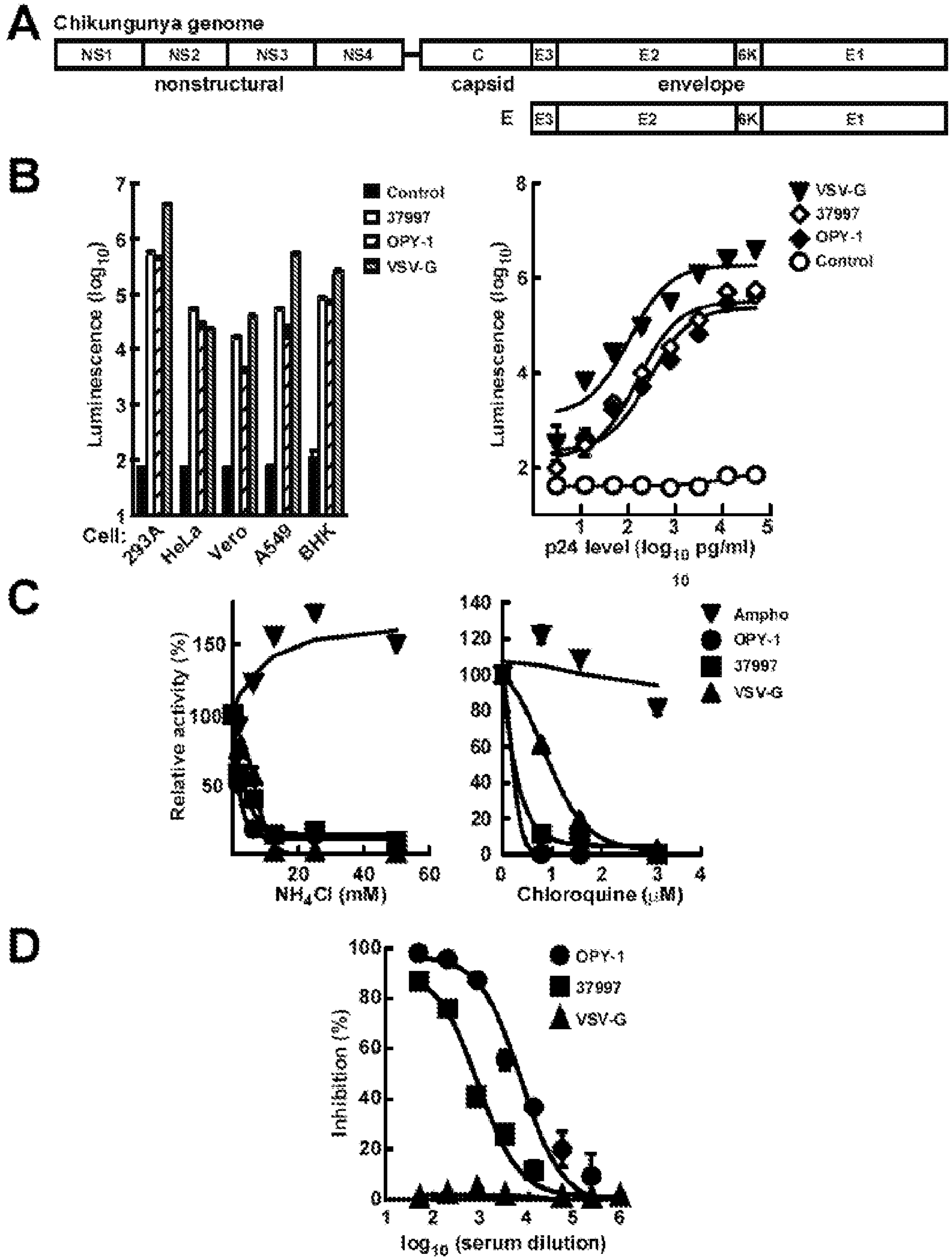
FIGS. 1A-1D show the characterization of CHIKV E pseudotyped lentiviral vectors.

The invention provides methods for enhancing alphavirus or flavivirus VLP production involving making one or more alterations in an E2 protein and/or a alphavirus capsid protein Nuclear Localization Signal (NLS).

The invention is based, at least in part, on the discovery that amino acid 234 in the CHIKV E2 protein plays an important role in allowing VLPs to bud efficiently from the cell membrane. Almost all alphaviruses have a lysine residue at the amino acid position corresponding to amino acid 234 in the CHIKV E2 protein. When this residue is converted from a lysine to an asparagine, use of the modified E2 protein in the alphavirus VLP expression system results in increased yield of VLPs. In addition, amino acid 251 in the CHIKV E2 protein has been shown to be important in stabilizing the E2 protein during viral budding. Modification of this residue to destabilize the E2 protein results also results in increased VLP synthesis. Therefore, use of an alphavirus E2 protein or a flavivirus envelope protein having a non-lysine residue (e.g., asparagine) at the amino acid position corresponding to amino acid 234 in the CHIKV E2 protein is a strategy for improving alphavirus VLP production, which will reduce the cost of making alphavirus VLP vaccines and delivery vehicles. Without being bound to a particular theory, it is believed that amino acid 234 resides within an acid sensitive (ASR) of the molecule. As shown herein, exposure of VLP to high pH conditions (pH>7.2, e.g., pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher), also improves VLP production.

The invention is also based, at least in part, on the discovery that amino acid 251 in the CHIKV E2 protein plays an important role in allowing VLPs to bud efficiently from the cell membrane. Amino acid 251 in the CHIKV E2 protein has been shown to be important in stabilizing the E2 protein during viral budding. Modification of this residue destabilizes the E2 protein during viral maturation, which results in increased VLP synthesis and VLP yield. Therefore, use of an alphavirus E2 protein having a modification at the amino acid position corresponding to amino acid 251 in the CHIKV E2 protein, which destabilizes the alphavirus E2 protein during viral budding, is another strategy for improving alphavirus VLP production.

The invention is also based, at least in part, on the discovery that alterations in the charged residues in the alphavirus capsid protein nuclear localization sequences provided or increased the expression of alphavirus VLPs and increased alphavirus VLP yields. Without being bound to a particular theory, the nuclear localization signal motif of the alphavirus capsid protein accumulates alphavirus capsid protein into the nucleus and prevents the secretion of alphavirus VLPs. It has been found that altering lysine and arginine residues in an alphavirus capsid protein NLS (e.g., to uncharged amino acids alanine or asparagine) improves alphavirus VLP production. Improvement in yields of alphavirus VLPs allows for their use as immunogenic compositions or vaccines, including a pan-alphavirus vaccine.

Accordingly, the invention provides nucleic acid molecules encoding alphavirus (e.g., CHIKV and WEEV) structural polypeptides, including an alphavirus E2 protein having a non-lysine residue (e.g., asparagine) at the amino acid position corresponding to amino acid 234 in the CHIKV E2 protein, expression vectors comprising these coding sequences, and methods of using these nucleic acid molecules for the preparation of virus-like particles. The invention also provides nucleic acid molecules encoding alphavirus (e.g., CHIKV and WEEV) structural polypeptides, including an alphavirus E2 protein having a modification at the amino acid position corresponding to amino acid 251 in the CHIKV E2 protein that destabilizes the E2 protein during viral budding, expression vectors comprising these coding sequences, and methods of using these nucleic acid molecules for the preparation of virus-like particles. The invention further provides immunogenic compositions containing one or more alphavirus (e.g., CHIKV and WEEV) structural polypeptides, including an E2 protein having a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In particular, the immunogenic composition (e.g., vaccine) contains envelope or capsid polypeptides sufficient to form a virus-like particle. In other embodiments, the invention provides DNA vaccines that provide for the expression of one or more viral polypeptides in the cell of a subject, including an alphavirus E2 protein having a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding.

The invention also provides nucleic acid molecules encoding flavivirus structural polypeptides, including an envelope protein having a non-lysine residue (e.g., asparagine) at the amino acid position corresponding to amino acid 234 in the CHIKV E2 protein, expression vectors comprising these coding sequences, and methods of using these nucleic acid molecules for the preparation of virus-like particles. The invention further provides immunogenic compositions containing one or more flavivirus structural polypeptides, including an envelope protein having a non-lysine residue (e.g., asparagine) at the amino acid position corresponding to amino acid 234 in the CHIKV E2 protein. In particular, the immunogenic composition (e.g., vaccine) contains envelope or capsid polypeptides sufficient to form a virus-like particle. In other embodiments, the invention provides DNA vaccines that provide for the expression of one or more viral polypeptides in the cell of a subject, including a flavivirus envelope protein having an asparagine residue at the amino acid position corresponding to amino acid 234 in the CHIKV E2 protein.

Alphavirus and Flavivirus Polynucleotides

In general, the invention includes any nucleic acid sequence encoding a VLP having an alteration in a structural protein that enhances VLP expression in a mammalian cell. In one embodiment, the alphavirus polypeptide(s) includes at least an alphavirus E2 protein or capsid protein NLS comprising an alteration that increases VLP expression in a mammalian cell. In one embodiment, the alphavirus E2 protein has a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In another embodiment, the alphavirus polypeptide(s) includes at least an alphavirus capsid protein having a non-lysine residue (e.g., alanine or asparagine) at an amino acid position corresponding to a lysine residue in an alphavirus capsid protein NLS and/or a non-arginine residue (e.g., alanine or asparagine) at an amino acid position corresponding to a arginine residue in an alphavirus capsid protein NLS. In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A and/or K68N. An isolated nucleic acid molecule can be manipulated by recombinant DNA techniques well known in the art. Thus, a nucleotide sequence contained in a vector in which 5' and 3' restriction sites are known, or for which polymerase chain reaction (PCR) primer sequences have been disclosed, is considered isolated, but a nucleic acid sequence existing in its native state in its natural host is not. In certain exemplary embodiments, the vector comprises CHIKV 37997 or WEEV 71V-1658 nucleic acid segments, or fragments thereof. The vector may further comprise a CMV/R promoter. The vector may also comprise the capsid protein, or a fragment thereof.

In other exemplary embodiments, in addition to the E2 protein, the vector comprises another envelope protein selected from the group consisting of E3, 6K, and E1. In certain examples, the vaccine may comprise capsid, E3, E2, 6K and E1. In other examples, the vaccine may comprise E3, E2, 6K and E1.

The invention also includes any nucleic acid sequence encoding a VLP comprising one or more flavivirus polypeptides or a fragment thereof, where the fragment induces an immune response. The flavivirus polypeptide(s) includes at least a flavivirus envelope protein having a non-lysine residue (e.g., asparagine) at the amino acid position corresponding to amino acid 234 in the CHIKV E2 protein. The flavivirus polypeptide(s) includes at least a flavivirus capsid protein having a non-lysine residue (e.g., alanine or asparagine) at an amino acid position corresponding to a lysine residue in a flavivirus capsid protein NLS and/or a non-arginine residue (e.g., alanine or asparagine) at an amino acid position corresponding to a arginine residue in a flavivirus capsid protein NLS. An isolated nucleic acid molecule can be manipulated by recombinant DNA techniques well known in the art.

In a particular embodiment, a nucleic acid molecule set forth in the sequences disclosed herein includes a nucleotide sequence encoding a polypeptide having at least about 50%, 60%, 70%, 75%, 80%, 81%, 82%, 83%, 84%, 85%, 86%, 87%, 88%, 89%, 90%, 91%, 92%, 93%, 94%, 95%, 96%, 97%, 98%, or more identity (e.g., when compared to the overall length of the amino acid sequence) to a polypeptide encoding a protein selected from alphavirus capsid, E3, E2, 6K and E1, including CHIKV or WEEV capsid, E3, E2, 6K and E1; and flavivirus envelope and capsid.

In some embodiments of the invention, proteins may comprise mutations containing alterations which produce silent substitutions, additions, or deletions, but do not alter the properties or activities of the encoded protein or how the proteins are made. Nucleotide variants can be produced for a variety of reasons, e.g., to optimize codon expression for a particular host, see U.S. patent publication 2005/0118191, herein incorporated by reference in its entirety for all purposes.

In addition, the nucleotides can be sequenced to ensure that the correct coding regions were cloned and do not contain any unwanted mutations. The nucleotides can be subcloned into an expression vector (e.g., baculovirus) for expression in any cell. A person with skill in the art understands that various subcloning methods are available and are possible.

An isolated nucleic acid may be substantially purified, but need not be. For example, a nucleic acid that is isolated within a cloning or expression vector is not pure in that it may comprise only a tiny percentage of the material in the cell in which it resides. Such a nucleic acid is isolated, as the term is used herein, because it is readily manipulatable by standard techniques known to those of ordinary skill in the art.

Polypeptide Expression

In general, VLPs comprising one or more alphavirus polypeptides of the invention may be produced by transformation of a suitable host cell with all or part of a polypeptide-encoding nucleic acid molecule or fragment thereof in a suitable expression vehicle.

Those skilled in the field of molecular biology will understand that any of a wide variety of expression systems may be used to provide the recombinant protein. The precise host cell used is not critical to the invention. A polypeptide of the invention may be produced in a prokaryotic host (e.g., *E. coli*) or in a eukaryotic host (e.g., *Saccharomyces cerevisiae*, insect cells, e.g., Sf21 cells, or mammalian cells, e.g., NIH 3T3, HeLa, COS cells). Such cells are available from a wide range of sources (e.g., the American Type Culture Collection, Rockland, Md.; also, see, e.g., Ausubel et al., supra). Non limiting examples of insect cells are, *Spodoptera frugiperda* (Sf) cells, e.g., Sf9, Sf21, *Trichoplusia ni* cells, e.g., High Five cells, and *Drosophila* S2 cells. Examples of fungi (including yeast) host cells are *S. cerevisiae, Kluyveromyces lactis* (*K lactis*), species of *Candida* including *C. albicans* and *C. glabrata, Aspergillus nidulans, Schizosaccharomyces pombe* (*S. pombe*), *Pichia pastoris*, and *Yarrowia lipolytica*. Examples of mammalian cells are COS cells, baby hamster kidney cells, mouse L cells, LNCaP cells, Chinese hamster ovary (CHO) cells, human embryonic kidney (HEK) cells, African green monkey cells, CV1 cells, HeLa cells, MDCK cells, Vero and Hep-2 cells. *Xenopus laevis* oocytes, or other cells of amphibian origin, may also be used. Prokaryotic host cells include bacterial cells, for example, *E. coli, B. subtilis*, and mycobacteria.

Methods of cloning said proteins are known in the art. For example, the gene encoding a specific alphavirus protein, e.g., a CHIKV, WEEV, EEEV, VEEV, Ross River virus, or Barmah Forest virus structural protein, or a specific flavivirus protein can be isolated by RT-PCR from polyadenylated mRNA extracted from cells which had been infected with said virus. The resulting product gene can be cloned as a DNA insert into a vector. The term "vector" refers to the means by which a nucleic acid can be propagated and/or transferred between organisms, cells, or cellular components. Vectors include plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. In many, but not all, common embodiments, the vectors of the present invention are plasmids or bacmids.

The invention further provides nucleotides that encode proteins, including chimeric molecules, cloned into an expression vector that can be expressed in a cell that provides for the formation of VLPs. An "expression vector" is a vector, such as a plasmid, that is capable of promoting expression, as well as replication of a nucleic acid incorporated therein. Typically, the nucleic acid molecule to be expressed is "operably linked" to a promoter and/or enhancer, and is subject to transcription regulatory control by the promoter and/or enhancer.

In one aspect, the invention provides an expression vector for expressing an alphavirus VLP having one or more alterations in an E2 protein and/or an alphavirus capsid protein Nuclear Localization Signal (NLS). In one embodiment, the VLP comprises one or more alphavirus envelope proteins, and in particular a CHIKV or WEEV E2 envelope protein having a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In another embodiment, the VLP further comprises any one or more of alphavirus envelope proteins E3, 6K, and E1. In another embodiment, the VLP further comprises an alphavirus capsid protein. In related embodiments, the CHIKV or WEEV capsid protein is used. In another embodiment, the VLP comprises of capsid, E3, E2, 6K, and E1. In still another embodiment, the VLP comprises one or more flavivirus envelope proteins. In related embodiments, the VLP further comprises one or more flavirus capsid proteins. In another embodiment, the expression vector is a mammalian expression vector or baculovirus vector.

In various embodiments, one or more charged residues in the nuclear localization sequence of an alphavirus (CHIKV, WEEV, EEEV, VEEV, Ross River virus, Barmah Forest virus) capsid protein are altered. In particular embodiments, the charged residues in the alphavirus capsid protein NLS are lysine and arginine. In specific embodiments, lysine and arginine in the alphavirus capsid protein NLS are replaced with an alanine or asparagine. In related embodiments, one or more alterations in an alphavirus capsid protein Nuclear Localization Signal (NLS) provides or increases the expression of alphavirus VLPs and increased alphavirus VLP yields. In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A and/or K68N.

The method of transformation or transfection and the choice of expression vehicle will depend on the host system selected. Transformation and transfection methods are described, e.g., in Ausubel et al. (supra); expression vehicles may be chosen from those provided, e.g., in Cloning Vectors: A Laboratory Manual (P. H. Pouwels et al., 1985, Supp. 1987).

A variety of expression systems exist for the production of the polypeptides of the invention. Expression vectors useful for producing such polypeptides include, without limitation, chromosomal, episomal, and virus-derived vectors, e.g., vectors derived from bacterial plasmids, from bacteriophage, from transposons, from yeast episomes, from insertion elements, from yeast chromosomal elements, from viruses such as baculoviruses, papova viruses, such as SV40, vaccinia viruses, adenoviruses, fowl pox viruses, pseudorabies viruses and retroviruses, and vectors derived from combinations thereof.

Constructs and/or vectors provided herein comprise alphavirus or flavivirus polynucleotides that encode structural polypeptides, including envelope proteins or capsid proteins or portions thereof as described herein. The vector may be, for example, a phage, plasmid, viral, or retroviral vector. The constructs and/or vectors that comprise the nucleotides should be operatively linked to an appropriate promoter, such as the CMV promoter, phage lambda PL promoter, the *E. coli* lac, phoA and tac promoters, the SV40 early and late promoters, and promoters of retroviral LTRs are non-limiting examples. Other suitable promoters will be known to the skilled artisan depending on the host cell and/or the rate of expression desired. The expression constructs will further contain sites for transcription initiation, termination, and, in the transcribed region, a ribosome-binding site for translation. The coding portion of the transcripts expressed by the constructs will preferably include a translation initiating codon at the beginning and a termination codon appropriately positioned at the end of the polypeptide to be translated.

Expression vectors will preferably include at least one selectable marker. Such markers include dihydrofolate reductase, G418 or neomycin resistance for eukaryotic cell culture and tetracycline, kanamycin or ampicillin resistance genes for culturing in *E. coli* and other bacteria. Among vectors preferred are virus vectors, such as baculovirus, poxvirus (e.g., vaccinia virus, avipox virus, canarypox virus, fowlpox virus, raccoonpox virus, swinepox virus, etc.), adenovirus (e.g., canine adenovirus), herpesvirus, and retrovirus. Other vectors that can be used with the invention comprise vectors for use in bacteria, which comprise pQE70, pQE60 and pQE-9, pBluescript vectors, Phagescript vectors, pNH8A, pNH16a, pNH18A, pNH46A, ptrc99a, pKK223-3, pKK233-3, pDR540, pRIT5. Among preferred eukaryotic vectors are pFastBac1 pWINEO, pSV2CAT, pOG44, pXT1 and pSG, pSVK3, pBPV, pMSG, and pSVL. Other suitable vectors will be readily apparent to the skilled artisan.

Recombinant constructs can be prepared and used to transfect, infect, or transform and can express viral proteins, including those described herein, into eukaryotic cells and/or prokaryotic cells. Thus, the invention provides for host cells which comprise a vector (or vectors) that contain nucleic acids which code for alphavirus structural genes, including capsid, E3, E2, 6K, and E1 or portions thereof, and/or any chimeric molecule described above, and permit the expression of alphavirus structural genes, including capsid E3, E2, 6K, and E1, or portions thereof, and/or any chimeric molecule described above in said host cell under conditions which allow the formation of VLPs. The invention also provides for host cells which comprise a vector (or vectors) that contain nucleic acids which code for flavivirus structural genes, including capsid, envelope, or portions thereof, and/or any chimeric molecule described above, and permit the expression of flavivirus structural genes, including capsid, envelope, or portions thereof, and/or any chimeric molecule described above in said host cell under conditions which allow the formation of VLPs In one embodiment, said vector is a recombinant baculovirus. In another embodiment, said recombinant baculovirus is transfected into an insect cell. In a preferred embodiment, said cell is an insect cell. In another embodiment, said insect cell is a Sf9 cell.

In another embodiment, said vector and/or host cell comprises nucleotides that encode alphavirus genes, including capsid, E3, E2, 6K, and E1, or portions thereof as described herein. In another embodiment, said vector and/or host cell consists essentially of alphavirus capsid, E3, E2, 6K, and E1, or portions thereof as described herein. In a further embodiment, said vector and/or host cell consists of alphavirus protein comprising capsid, E3, E2, 6K, and E1, or portions thereof, as described herein. These vector and/or host cell contain alphavirus core, E3, E2, 6K, and E1, or portions thereof, as described herein, and may contain additional cellular constituents such as cellular proteins, baculovirus proteins, lipids, carbohydrates etc.

In another embodiment, said vector and/or host cell comprises nucleotides that encode flavivirus genes, including capsid, envelope, or portions thereof as described herein. In another embodiment, said vector and/or host cell consists essentially of alphavirus flavivirus capsid, envelope, or portions thereof as described herein. These vector and/or host cell may contain additional cellular constituents such as cellular proteins, baculovirus proteins, lipids, carbohydrates etc.

One particular bacterial expression system for polypeptide production is the *E. coli* pET expression system (Novagen, Inc., Madison, Wis.). According to this expression system, DNA encoding a polypeptide is inserted into a pET vector in an orientation designed to allow expression. Since the gene encoding such a polypeptide is under the control of the T7 regulatory signals, expression of the polypeptide is achieved by inducing the expression of T7 RNA polymerase in the host cell. This is typically achieved using host strains that express T7 RNA polymerase in response to IPTG induction. Once produced, a recombinant polypeptide is then isolated according to standard methods known in the art, for example, those described herein.

Another bacterial expression system for polypeptide production is the pGEX expression system (Pharmacia). This system employs a GST gene fusion system that is designed for high-level expression of genes or gene fragments as fusion proteins with rapid purification and recovery of functional gene products. The protein of interest is fused to the carboxyl terminus of the glutathione S-transferase protein from *Schistosoma japonicum* and is readily purified from bacterial lysates by affinity chromatography using Glutathione Sepharose 4B. Fusion proteins can be recovered under mild conditions by elution with glutathione. Cleavage of the glutathione S-transferase domain from the fusion protein is facilitated by the presence of recognition sites for site-specific proteases upstream of this domain. For example, proteins expressed in pGEX-2T plasmids may be cleaved with thrombin; those expressed in pGEX-3X may be cleaved with factor Xa.

Once a recombinant polypeptide of the invention is expressed, it is isolated, e.g., using affinity chromatography. In one example, an antibody (e.g., produced as described herein) raised against a polypeptide of the invention may be attached to a column and used to isolate the recombinant polypeptide. Lysis and fractionation of polypeptide-harboring cells prior to affinity chromatography may be performed by standard methods (see, e.g., Ausubel et al., supra).

Once isolated, the recombinant protein can, if desired, be further purified, e.g., by high performance liquid chromatography (see, e.g., Fisher, Laboratory Techniques In Biochemistry and Molecular Biology, eds., Work and Burdon, Elsevier, 1980). Polypeptides of the invention, particularly short peptide fragments, can also be produced by chemical synthesis (e.g., by the methods described in Solid Phase Peptide Synthesis, 2nd ed., 1984 The Pierce Chemical Co., Rockford, Ill.). These general techniques of polypeptide expression and purification can also be used to produce and isolate useful peptide fragments or analogs (described herein).

Alphavirus and Flavivirus Polypeptides and Analogs

The invention provides VLPs comprising one or more alphavirus, CHIKV, WEEV, EEEV, VEEV, Ross River virus, Barmah Forest virus, or flavivirus polypeptides. Also included in the invention are VLPs comprising one or more alphavirus, CHIKV, WEEV, EEEV, VEEV, Ross River virus, Barmah Forest virus, or flavivirus polypeptides or fragments thereof that are modified in ways that enhance or do not inhibit their ability to modulate an immune response. In one embodiment, the invention provides methods for optimizing an alphavirus, CHIKV, WEEV, EEEV, VEEV, Ross River virus, Barmah Forest virus, or flavivirus amino acid sequence or nucleic acid sequence by producing an alteration. Such alterations may include certain mutations, deletions, insertions, or post-translational modifications. The invention further includes analogs of any naturally-occurring polypeptide of the invention. Analogs can differ from the naturally-occurring the polypeptide of the invention by amino acid sequence differences, by post-translational modifications, or by both. Analogs of the invention will generally exhibit at least 85%, more preferably 90%, and most preferably 95% or even 99% identity with all or part of a naturally-occurring amino, acid sequence of the invention.

The length of sequence comparison is at least 10, 13, 15 amino acid residues, preferably at least 25 amino acid residues, and more preferably more than 35 amino acid residues.

Alterations of an alphavirus, CHIKV, WEEV, EEEV, VEEV, Ross River virus, Barmah Forest virus, or flavivirus polypeptide include but are not limited to site-directed, random point mutagenesis, homologous recombination (DNA shuffling), mutagenesis using uracil containing templates, oligonucleotide-directed mutagenesis, phosphorothioate-modified DNA mutagenesis, mutagenesis using gapped duplex DNA or the like. Additional suitable methods include point mismatch repair, mutagenesis using repair-deficient host strains, restriction-selection and restriction-purification, deletion mutagenesis, mutagenesis by total gene synthesis, double-strand break repair, and the like. Mutagenesis, e.g., involving chimeric constructs, is also included in the present invention. In one embodiment, mutagenesis can be guided by known information of the naturally occurring molecule or altered or mutated naturally occurring molecule, e.g., sequence, sequence comparisons, physical properties, crystal structure or the like.

In one embodiment, the invention provides polypeptide variants that differ from a reference polypeptide. The term "variant" refers to an amino acid sequence that is altered by one or more amino acids with respect to a reference sequence. The variant can have "conservative" changes, wherein a substituted amino acid has similar structural or chemical properties, e.g., replacement of leucine with isoleucine. Alternatively, a variant can have "nonconservative" changes, e.g., replacement of a glycine with a tryptophan. Analogous minor variations can also include amino acid deletion or insertion, or both. Guidance in determining which amino acid residues can be substituted, inserted, or deleted without eliminating biological or immunological activity can be found using computer programs well known in the art, for example, DNASTAR software. Desirably, variants show substantial biological activity. In one embodiment, a protein variant forms a VLP and elicits an antibody response when administered to a subject.

Natural variants can occur due to mutations in the proteins. These mutations may lead to antigenic variability within individual groups of infectious agents. Thus, a person infected with a particular strain develops antibody against that virus, as newer virus strains appear, the antibodies against the older strains no longer recognize the newer virus and reinfection can occur. The invention encompasses all antigenic and genetic variability of proteins from infectious agents for making VLPs.

Again, in an exemplary approach to determining the degree of identity, a BLAST program may be used, with a probability score between $e^{-3}$ and $e^{-100}$ indicating a closely related sequence. Modifications include in vivo and in vitro chemical derivatization of polypeptides, e.g., acetylation, carboxylation, phosphorylation, or glycosylation; such modifications may occur during polypeptide synthesis or processing or following treatment with isolated modifying enzymes. Analogs can also differ from the naturally-occurring polypeptides of the invention by alterations in primary sequence. These include genetic variants, both natural and induced (for example, resulting from random mutagenesis by irradiation or exposure to ethanemethylsulfate or by site-specific mutagenesis as described in Sambrook, Fritsch and Maniatis, Molecular Cloning: A Laboratory Manual (2d ed.), CSH Press, 1989, or Ausubel et al., supra). Also included are cyclized peptides, molecules, and analogs which contain residues other than L-amino acids, e.g., D-amino acids or non-naturally occurring or synthetic amino acids, e.g., .beta. or .gamma. amino acids.

In addition to full-length polypeptides, the invention also includes fragments of any one of the polypeptides of the invention. As used herein, the term "a fragment" means at least 5, 10, 13, or 15. In other embodiments a fragment is at least 20 contiguous amino acids, at least 30 contiguous amino acids, or at least 50 contiguous amino acids, and in other embodiments at least 60 to 80 or more contiguous amino acids. Fragments of the invention can be generated by methods known to those skilled in the art or may result from normal protein processing (e.g., removal of amino acids from the nascent polypeptide that are not required for biological activity or removal of amino acids by alternative mRNA splicing or alternative protein processing events).

Non-protein analogs having a chemical structure designed to mimic alphavirus, CHIKV, WEEV, EEEV, VEEV, Ross River virus, Barmah Forest virus, or flavivirus VLPs or one or more alphavirus, CHIKV, WEEV, EEEV, VEEV, Ross River virus, Barmah Forest virus, or flavivirus polypeptides functional activity can be administered according to methods of the invention. Alphavirus, CHIKV, WEEV, EEEV, VEEV, Ross River virus, Barmah Forest virus, or flavivirus analogs may exceed the physiological activity of native alphavirus, CHIKV, WEEV, EEEV, VEEV, Ross River virus, Barmah Forest virus, or flavivirus. Methods of analog design are well known in the art, and synthesis of analogs can be carried out according to such methods by modifying the chemical structures such that the resultant analogs exhibit the immunomodulatory activity of a native alphavirus, CHIKV, WEEV, EEEV, VEEV, Ross River virus, Barmah Forest virus, or flavivirus polypeptide. These chemical modifications include, but are not limited to, substituting alternative R groups and varying the degree of saturation at specific carbon atoms of the native alphavirus, CHIKV, WEEV, EEEV, VEEV, Ross River virus, Barmah Forest virus, or flavivirus molecule. Preferably, the analogs are relatively resistant to in vivo degradation, resulting in a more prolonged therapeutic effect upon administration. Assays for measuring functional activity include, but are not limited to, those described in the Examples below.

Alphavirus and Flavivirus VLP Production

The invention also provides constructs and methods for producing a VLP comprising alphavirus or flavivirus polypeptides, or fragments thereof, as well as compositions and methods that increase the efficiency of VLP production. In embodiments, inclusion of an alphavirus E2 protein or a flavivirus envelope protein having a non-lysine residue (e.g., asparagine) at the amino acid position corresponding to amino acid 234 in the CHIKV E2 protein results in enhanced VLP production. In embodiments, inclusion of an alphavirus E2 protein having a modification at the amino acid position corresponding to amino acid 251 in the CHIKV E2 protein that destabilizes the E2 protein during viral budding results in enhanced VLP production. In a related embodiment, VLP are exposed to high pH, basic, or non-acidic conditions during VLP production (e.g., in cell culture, during purification). In specific embodiments, the pH is at least about 7.2 (pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher). In certain embodiments, the addition of leader sequences to the alphavirus capsid, E3, E2, 6K, E1, or portions thereof, or to flavivirus capsid, envelope, or portions thereof, can improve the efficiency of protein transporting within the cell. In another example, a heterologous signal sequence can be fused to the alphavirus capsid, E3, E2, 6K, E1, or portions thereof, or to flavivirus capsid, envelope, or portions thereof. In one embodiment, the signal sequence can be derived from the gene of an insect cell. Another method to increase efficiency of VLP production is to codon optimize the nucleotides that encode alphavirus capsid, E3, E2, 6K, E1, or portions thereof, or flavivirus capsid, envelope, or portions thereof for a specific cell type.

In various embodiments, one or more charged residues in the nuclear localization sequence of an alphavirus (CHIKV, WEEV, EEEV, VEEV, Ross River virus, Barmah Forest virus) capsid protein are altered. In particular embodiments, the charged residues in the alphavirus capsid protein NLS are lysine and arginine. In specific embodiments, lysine and arginine in the alphavirus capsid protein NLS are replaced with an alanine or asparagine. In related embodiments, one or more alterations in an alphavirus capsid protein Nuclear Localization Signal (NLS) provides or increases the expression of alphavirus VLPs and increased alphavirus VLP yields. In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A, and/or K68N.

Methods of cloning said proteins are known in the art. For example, the gene encoding a specific alphavirus protein can be isolated by RT-PCR from polyadenylated mRNA extracted from cells which had been infected with said virus. The resulting gene can be cloned as a DNA insert into a vector. The term “vector” refers to the means by which a nucleic acid can be propagated and/or transferred between organisms, cells, or cellular components. Vectors include plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. In many, but not all, common embodiments, the vectors of the present invention are plasmids or bacmids.

Thus, the invention comprises nucleotides that encode proteins, including chimeric molecules, cloned into an expression vector that can be expressed in a cell that induces the formation of VLPs of the invention. An “expression vector” is a vector, such as a plasmid that is capable of promoting expression, as well as replication of a nucleic acid incorporated therein. Typically, the nucleic acid to be expressed is “operably linked” to a promoter and/or enhancer, and is subject to transcription regulatory control by the promoter and/or enhancer. In embodiments, the VLP comprises an alphavirus E2 envelope protein having a non-lysine residue (e.g., asparagine) at the amino acid position corresponding to amino acid 234 in the CHIKV E2 protein, and in particular a CHIKV or WEEV E2 protein. In embodiments, the VLP comprises an alphavirus E2 envelope protein having a modification at the amino acid position corresponding to amino acid 251 in the CHIKV E2 protein that destabilizes the E2 protein during viral budding. In another embodiment, the VLP further comprises one or more additional envelope proteins selected from the group consisting of E3, 6K and E1. In another embodiment, the VLP comprises an alphavirus capsid protein. In related embodiments, the CHIKV or WEEV capsid protein is used. In another embodiment, the VLPs are comprised of E3, E2, 6K and E1. In still another embodiment, the VLPs are comprised of capsid, E3, E2, 6K and E1. In embodiments, the VLP comprises a flavivirus envelope protein having a non-lysine residue (e.g., asparagine) at the amino acid position corresponding to amino acid 234 in the CHIKV E2 protein. In another embodiment, the VLP comprises a flavivirus capsid protein. In another embodiment, the expression vector is a baculovirus vector.

The invention also provides methods of producing a VLP comprising alphavirus or flavivirus polypeptides, or fragments thereof, including an alphavirus E2 polypeptide or a flavivirus envelope polypeptide that has a non-lysine residue (e.g., asparagine) at the amino acid position corresponding to amino acid 234 in the CHIKV E2 protein. In embodiments, the alphavirus E2 polypeptide has a modification at the amino acid position corresponding to amino acid 251 in the CHIKV E2 protein that destabilizes the E2 protein during viral budding. In one example, the method involves expressing in a cell a polynucleotide encoding an alphavirus polypeptide, such as an CHIKV or WEEV polypeptide, or a flavivirus polypeptide and culturing said cell, thereby producing VLPs. In one embodiment, a cell (e.g., human cell) is infected with a DNA vaccine, where the DNA vaccine is a DNA vector, comprising a nucleic acid segment encoding an alphavirus capsid protein or one or more alphavirus envelope proteins, or fragments thereof to produce an alphavirus VLP. In particular, the alphavirus is CHIKV or WEEV. In another embodiment, a cell (e.g., human cell) is infected with a DNA vaccine, where the DNA vaccine is a DNA vector, comprising a nucleic acid segment encoding an flavivirus capsid protein or one or more flavivirus envelope proteins, or fragments thereof to produce a flavivirus VLP.

Depending on the expression system and host cell selected, the VLPs are produced by growing host cells transformed by an expression vector under conditions whereby the recombinant proteins are expressed and VLPs are formed. In one embodiment, the invention comprises a method of producing a VLP, that involves transfecting vectors encoding at least one alphavirus protein into a suitable host cell and expressing said alphavirus protein under conditions that allow VLP formation. In another embodiment, the eukaryotic cell is selected from the group consisting of, yeast, insect, amphibian, avian or mammalian cells. The selection of the appropriate growth conditions is within the skill or a person with skill of one of ordinary skill in the art.

Methods to grow cells that produce VLPs of the invention include, but are not limited to, batch, batch-fed, continuous and perfusion cell culture techniques. In one embodiment, a cell comprising an alphavirus polynucleotide, such as a CHIKV or WEEV polynucleotide, or a flavivirus polynucleotide, is grown in a bioreactor or fermentation chamber where cells propagate and express protein (e.g., recombinant proteins) for purification and isolation. Typically, cell culture is performed under sterile, controlled temperature and atmospheric conditions. A bioreactor is a chamber used to culture cells in which environmental conditions such as temperature, atmosphere, agitation and/or pH can be monitored. In one embodiment, the bioreactor is a stainless steel chamber. In another embodiment, said bioreactor is a pre-sterilized plastic bag (e.g., Cellbag®, Wave Biotech, Bridgewater, N.J.). In other embodiment, said pre-sterilized plastic bags are about 50 L to 1000 L bags.

The VLPs are isolated using methods that preserve the integrity thereof, such as by gradient centrifugation, e.g., cesium chloride, sucrose and iodixanol, as well as standard purification techniques including, e.g., ion exchange and gel filtration chromatography.

The following is an example of how VLPs of the invention can be made, isolated and purified. A person of skill in the art appreciates that there are additional methods that can be used to make and purify VLPs. Accordingly, the invention is not limited to the methods described herein.

In general, production of VLPs of the invention is accomplished by seeding a mammalian cell (e.g., human embryonic kidney (293T) cells) or Sf9 cells (non-infected) into shaker flasks, allowing the cells to expand and scaling up as the cells grow and multiply (for example from a 125-ml flask to a 50 L Wave bag). The medium used to grow the cells is formulated for the appropriate cell line (preferably serum free media, e.g., insect medium ExCell-420, JRH). Next, the cells are transfected or infected with an appropriate vector (e.g., mammalian expression vector or for SF (cells recombinant baculovirus at the most efficient multiplicity of infection (e.g., from about 1 to about 3 plaque forming units per cell). The polynucleotides, or portions thereof, are expressed in the cells where they self assemble into VLPs and are secreted from the cells approximately 24 to 72 hours post infection. Usually, transfection or infection is most efficient when the cells are in mid-log phase of growth ($4\text{-}8.\times10^6$ cells/ml) and are at least about 90% viable. Additionally, the transfected cells may be exposed to high pH conditions in cell culture (pH>7.2, e.g., pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher) to increase VLP production.

VLPs of the invention are harvested approximately 48 to 120 hours post infection, when the levels of VLPs in the cell culture medium are near the maximum but before extensive cell lysis. The cell density and viability at the time of harvest can be about $0.5\times10^6$ cells/ml to about $1.5\times10^6$ cells/ml with at least 20% viability, as shown by dye exclusion assay. Next, the medium is removed and clarified. NaCl can be added to the medium to a concentration of about 0.4 to about 1.0 M, preferably to about 0.5 M, to avoid VLP aggregation. The removal of cell and cellular debris from the cell culture medium containing VLPs of the invention can be accomplished by tangential flow filtration (TFF) with a single use, pre-sterilized hollow fiber 0.5 or 1.00 μm filter cartridge or a similar device. Additionally, the VLPs may be exposed to high pH conditions during purification (pH>7.2, e.g., pH 7.2, 7.3, 7.4, 7.5, 7.6, 7.7, 7.8, 7.9, 8.0, 8.1, 8.2, 8.3, 8.4, 8.5, 8.6, 8.7, 8.8, or higher) to increase VLP production.

Next, VLPs in the clarified culture medium are concentrated by ultrafiltration using a disposable, pre-sterilized 500,000 molecular weight cut off hollow fiber cartridge. The concentrated VLPs can be diafiltrated against 10 volumes pH 7.0 to 8.0 phosphate-buffered saline (PBS) containing 0.5 M NaCl to remove residual medium components.

The concentrated, diafiltered VLPs can be furthered purified on a 20% to 60% discontinuous sucrose gradient in pH 7.2 PBS buffer with 0.5 M NaCl by centrifugation at 6,500×g for 18 hours at about 4 C to about 10 C. Usually VLPs will form a distinctive visible band between about 30% to about 40% sucrose or at the interface (in a 20% and 60% step gradient) that can be collected from the gradient and stored. This product can be diluted to comprise 200 mM of NaCl in preparation for the next step in the purification process. This product contains VLPs and may contain intact baculovirus particles.

Further purification of VLPs can be achieved by anion exchange chromatography, or 44% isopycnic sucrose cushion centrifugation. In anion exchange chromatography, the sample from the sucrose gradient (see above) is loaded into column containing a medium with an anion (e.g., Matrix Fractogel EMD TMAE) and eluded via a salt gradient (from about 0.2 M to about 1.0 M of NaCl) that can separate the VLP from other contaminates (e.g., baculovirus and DNA/RNA). In the sucrose cushion method, the sample comprising the VLPs is added to a 44% sucrose cushion and centrifuged for about 18 hours at 30,000 g. VLPs form a band at the top of 44% sucrose, while baculovirus precipitates at the bottom and other contaminating proteins stay in the 0% sucrose layer at the top. The VLP peak or band is collected.

The intact baculovirus can be inactivated, if desired. Inactivation can be accomplished by chemical methods, for example, formalin or .beta.-propiolactone (BPL). Removal and/or inactivation of intact baculovirus can also be largely accomplished by using selective precipitation and chromatographic methods known in the art, as exemplified above. Methods of inactivation comprise incubating the sample containing the VLPs in 0.2% of BPL for 3 hours at about 25° C. to about 27° C. The baculovirus can also be inactivated by incubating the sample containing the VLPs at 0.05% BPL at 4° C. for 3 days, then at 37° C. for one hour.

After the inactivation/removal step, the product comprising VLPs can be run through another diafiltration step to remove any reagent from the inactivation step and/or any residual sucrose, and to place the VLPs into the desired buffer (e.g., PBS). The solution comprising VLPs can be sterilized by methods known in the art (e.g., sterile filtration) and stored in the refrigerator or freezer.

The above techniques can be practiced across a variety of scales. For example, T-flasks, shake-flasks, spinner bottles, up to industrial sized bioreactors. The bioreactors can comprise either a stainless steel tank or a pre-sterilized plastic bag (for example, the system sold by Wave Biotech, Bridgewater, N.J.). A person with skill in the art will know what is most desirable for their purposes.

As described herein, upon administration to a desired host, the VLPs of the present invention are taken up by cells normally infected by the particular virus. When the VLP contains/packages a target agent, the agent is internalized into the cell upon VLP entry. This property facilitates the use of the VLPs described herein as delivery vehicles because they enable the delivery of a target agent(s) into a desired cell.

Thus, in certain embodiments, a DNA vaccine or VLP comprises an agent(s), such as a therapeutic or diagnostic agent(s) that needs to be delivered to a subject, e.g., imaging agent, nucleic acid sequence (including siRNA and microRNA), radionuclide, hormone, peptide, antiviral agent, antitumor/chemotherapeutic agent, cell growth modulating agent, cell growth inhibitor, cytokine, antigen, adjuvant, toxin, etc. The agent encapsulated should not adversely affect the VLP, or VLP stability. This may be determined by producing VLP containing the desired agent and assessing its effects, if any, on VLP stability.

Accordingly, the present invention provides methods for introducing an agent into a cell. In embodiments, the agent is packaged into a VLP as described herein, producing a packed VLP. In related embodiments, the packed VLP is contacted with a cell. In related embodiments, the packed VLP is allowed to enter the cell, thereby resulting in delivery of the agent into the cell.

In embodiments, the invention provides methods of treating viral diseases and/or disorders or symptoms thereof which comprise administering a therapeutically effective amount of a pharmaceutical composition comprising a VLP or DNA of the formulae herein to a subject (e.g., a mammal such as a human). Thus, one embodiment is a method of treating a subject suffering from or susceptible to a viral infection, viral disease or disorder or symptom thereof. The method includes the step of administering to the mammal a therapeutic or prophylactic amount of an amount of a compound herein sufficient to treat the disease or disorder or symptom thereof, under conditions such that the disease or disorder is prevented or treated.

The methods herein include administering to the subject (including a subject identified as in need of such treatment) an effective amount of a compound described herein, or a composition described herein to produce such effect. Identifying a subject in need of such treatment can be in the judgment of a subject or a health care professional and can be subjective (e.g., opinion) or objective (e.g., measurable by a test or diagnostic method).

As used herein, the terms "treat," treating," "treatment," and the like refer to reducing or ameliorating a disorder and/or symptoms associated therewith. It will be appreciated that, although not precluded, treating a disorder or condition does not require that the disorder, condition or symptoms associated therewith be completely eliminated.

As used herein, the terms "prevent," "preventing," "prevention," "prophylactic treatment" and the like refer to reducing the probability of developing a disorder or condition in a subject, who does not have, but is at risk of or susceptible to developing a disorder or condition.

The therapeutic methods of the invention (which include prophylactic treatment) in general comprise administration of a therapeutically effective amount of the agents herein, such as a VLP or DNA of a formulae herein to a subject (e.g., animal, human) in need thereof, including a mammal, particularly a human. Such treatment will be suitably administered to subjects, particularly humans, suffering from, having, susceptible to, or at risk for a disease, disorder, or symptom thereof. Determination of those subjects "at risk" can be made by any objective or subjective determination by a diagnostic test or opinion of a subject or health care provider (e.g., genetic test, enzyme or protein marker, Marker (as defined herein), family history, and the like). The agents herein may be also used in the treatment of any other disorders in which an alphavirus may be implicated.

In one embodiment, the invention provides a method of monitoring treatment progress. The method includes the step of determining a level of diagnostic marker (Marker) (e.g., any target delineated herein modulated by a compound herein, a protein or indicator thereof, etc.) or diagnostic measurement (e.g., screen, assay) in a subject suffering from or susceptible to a disorder or symptoms thereof associated with an alphavirus, in which the subject has been administered a therapeutic amount of a compound herein sufficient to treat the disease or symptoms thereof. The level of Marker determined in the method can be compared to known levels of Marker in either healthy normal controls or in other afflicted patients to establish the subject's disease status. In preferred embodiments, a second level of Marker in the subject is determined at a time point later than the determination of the first level, and the two levels are compared to monitor the course of disease or the efficacy of the therapy. In certain preferred embodiments, a pre-treatment level of Marker in the subject is determined prior to beginning treatment according to this invention; this pre-treatment level of Marker can then be compared to the level of Marker in the subject after the treatment commences, to determine the efficacy of the treatment.

Immunogenic Compositions

The invention provides compositions and methods for inducing an immunological response in a subject, particularly a human, which involves inoculating the subject with a VLP as described herein in a suitable carrier for the purpose of inducing or enhancing an immune response. In one embodiment, an immune response protects the subject from an alphavirus infection, such as a CHIKV, WEEV, EEEV, VEEV, Ross River virus, or Barmah Forest virus infection, a flavivirus infection, or inflammatory consequences thereof (e.g., arthritis). The administration of this immunological composition may be used either therapeutically in subjects already experiencing an alphavirus infection, such as a CHIKV or WEEV infection, or may be used prophylactically to prevent an alphavirus infection. The administration of this immunological composition may also be used either therapeutically in subjects already experiencing a flavivirus infection or prophylactically to prevent a flavivirus infection.

In certain embodiments, the alphavirus candidate vaccines were developed by comparing the immunogenicity of gene products derived from two disparate strains, the 37997 strain from West Africa and the latest outbreak strain, OPY-1, of the East/Central/South African genotype. These strains share ~95% amino acid sequence similarity but have distinct biological differences, particularly related to their host range. In particular, the presence of a non-lysine residue (e.g., asparagine) at amino acid 234 in the CHIKV E2 protein resulted in enhanced VLP production. The introduction of a non-lysine residue (e.g., asparagine) into other alphaviruses at the amino acid position corresponding to amino acid 234 in the CHIKV E2 protein also resulted in enhanced VLP production of other alphaviruses. In addition, modification of the amino acid position corresponding to amino acid 251 in the CHIKV E2 protein further destabilized the E2 protein during viral budding, resulting in enhanced VLP production.

VLPs of the invention are useful for preparing vaccines and immunogenic compositions. One important feature of VLPs is the ability to express surface proteins so that the immune system of a vertebrate induces an immune response against said protein. However, not all proteins can be expressed on the surface of VLPs. There may be many reasons why certain proteins are not expressed, or be poorly expressed, on the surface of VLPs. One reason is that said protein is not directed to the membrane of a host cell or that said protein does not have a transmembrane domain.

The preparation of immunogenic compositions and vaccines is known to one skilled in the art. The immunogenic composition or vaccine includes a VLP comprising one or more alphavirus polypeptides, one or more flavivirus polypeptides, or fragments thereof, where the VLP has one or more alterations in an alphavirus E2 protein and/or an alphavirus capsid protein Nuclear Localization Signal (NLS). The immunogenic composition or vaccine may include a VLP comprising an alphavirus E2 polypeptide or a flavivirus envelope polypeptide that has a non-lysine residue (e.g., asparagine) at the amino acid position corresponding to amino acid 234 in the CHIKV E2 protein. The alphavirus E2 polypeptide may have a modification at the amino acid position corresponding to amino acid 251 in the CHIKV E2 protein that destabilizes the E2 protein during viral budding. The immunogenic composition or vaccine may include a VLP comprising an alphavirus (CHIKV, WEEV, EEEV, VEEV, Ross River virus, Barmah Forest virus) capsid protein in which the nuclear localization sequence is altered. The alphavirus capsid protein nuclear localization sequence is altered in a charged residue (e.g., lysine or arginine), which is replaced with a non-charged residue (e.g., alanine or asparagine). In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A and/or K68N.

The invention also provides expression vectors encoding one or more alphavirus polypeptides, flavivirus polypeptides, or fragments thereof or variants thereof, including an alphavirus E2 polypeptide or a flavivirus envelope polypeptide that has a non-lysine residue (e.g., asparagine) at the amino acid position corresponding to amino acid 234 in the CHIKV E2 protein. The alphavirus E2 polypeptide may have a modification at the amino acid position corresponding to amino acid 251 in the CHIKV E2 protein that destabilizes the E2 protein during viral budding. Such an immunogenic composition is delivered in vivo in order to induce or enhance an immunological response in a subject, such as a humoral response.

For example, a VLP comprising one or more CHIKV or WEEV polypeptides or fragments or variants thereof, including a CHIKV or WEEV E2 polypeptide that has a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding, are delivered in vivo in order to induce an immune response.

Typically vaccines are prepared in an injectable form, either as a liquid solution or as a suspension. Solid forms suitable for injection may also be prepared as emulsions, or with the polypeptides encapsulated in liposomes. Vaccine antigens are usually combined with a pharmaceutically acceptable carrier, which includes any carrier that does not induce the production of antibodies harmful to the subject receiving the carrier. Suitable carriers typically comprise large macromolecules that are slowly metabolized, such as proteins, polysaccharides, polylactic acids, polyglycolic acids, polymeric amino acids, amino acid copolymers, lipid aggregates, and inactive virus particles. Such carriers are well known to those skilled in the art. These carriers may also function as adjuvants.

The VLPs described herein may be administered in combination with an adjuvant (e.g., Ribi). Adjuvants are immunostimulating agents that enhance vaccine effectiveness. If desired, the VLP comprising one or more alphavirus polypeptides or fragments or variants thereof are administered in combination with an adjuvant that enhances the effectiveness of the immune response generated against the antigen of interest. Effective adjuvants include, but are not limited to, aluminum salts such as aluminum hydroxide and aluminum phosphate, muramyl peptides, bacterial cell wall components, saponin adjuvants, and other substances that act as immunostimulating agents to enhance the effectiveness of the composition.

Immunogenic compositions, i.e., the VLPs described herein, pharmaceutically acceptable carrier and adjuvant, also typically contain diluents, such as water, saline, glycerol, ethanol. Auxiliary substances may also be present, such as wetting or emulsifying agents, pH buffering substances, and the like. Proteins may be formulated into the vaccine as neutral or salt forms. The immunogenic compositions are typically administered parenterally, by injection; such injection may be either subcutaneously or intramuscularly. Additional formulations are suitable for other forms of administration, such as by suppository or orally. Oral compositions may be administered as a solution, suspension, tablet, pill, capsule, or sustained release formulation.

Immunogenic compositions are administered in a manner compatible with the dose formulation. The immunogenic composition comprises an immunologically effective amount of the VLP described herein and other previously mentioned components. By an immunologically effective amount is meant a single dose, or a composition administered in a multiple dose schedule, that is effective for the treatment or prevention of an infection. The dose administered will vary, depending on the subject to be treated, the subject's health and physical condition, the capacity of the subject's immune system to produce antibodies, the degree of protection desired, and other relevant factors. Precise amounts of the active ingredient required will depend on the judgement of the practitioner, but typically range between 5 μg to 250 μg of antigen per dose.

The invention provides a VLP for use in treating or preventing an alphavirus infection (e.g., CHIKV or WEEV infection). The invention also provides a VLP for use in treating or preventing a flavivirus infection.

Pharmaceutical Compositions and Administration

The invention features pharmaceutical compositions that comprise VLPs as described herein. The pharmaceutical compositions useful herein contain a pharmaceutically acceptable carrier, including any suitable diluent or excipient, which includes any pharmaceutical agent that does not itself induce the production of an immune response harmful to the vertebrate receiving the composition, and which may be administered without undue toxicity and a VLP of the invention. As used herein, the term "pharmaceutically acceptable" means being approved by a regulatory agency of the Federal or a state government or listed in the U.S. Pharmacopia, European Pharmacopia or other generally recognized pharmacopia for use in mammals, and more particularly in humans. These compositions can be useful as a vaccine and/or antigenic compositions for inducing a protective immune response in a vertebrate.

In particular embodiments, the invention encompasses an antigenic formulation comprising VLPs which comprises at least one viral protein, for example one alphavirus protein or one flavivirus protein. The alphavirus may be selected from the group consisting of, but not limited to, EEEV, WEEV, VEEV, SFV, CHIKV, Ross River virus, Barmah Forest virus, O'nyong-nyong virus, Sindbis virus, Mayaro virus, and Ockelbo virus.

In certain embodiments, the pharmaceutical compositions comprise alphavirus or flavivirus VLPs and a pharmaceutically acceptable carrier. In certain preferred embodiments, the pharmaceutical composition comprises VLPs of CHIKV, WEEV, EEEV, VEEV, Ross River virus, or Barmah Forest virus, and a pharmaceutically acceptable carrier. In other certain preferred embodiments, the pharmaceutical composition comprises VLPs of CHIKV, WEEV, EEEV, VEEV, Ross River virus, or Barmah Forest virus, an adjuvant, and a pharmaceutically acceptable carrier.

In embodiments, the VLPs comprise an alphavirus (CHIKV, WEEV, EEEV, VEEV, Ross River virus, Barmah Forest virus) VLP having one or more alterations in an E2 protein and/or an alphavirus capsid protein Nuclear Localization Signal (NLS). In embodiments, the VLPs are comprised of CHIKV, WEEV, EEEV, VEEV, Ross River virus, Barmah Forest virus envelope proteins, including a CHIKV or WEEV E2 envelope protein having a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In embodiments, the VLPs comprise additional CHIKV or WEEV envelope proteins selected from the group consisting of CHIKV or WEEV E3, 6K, and E1 envelope proteins. In another embodiment, the pharmaceutical composition further comprises a CHIKV or WEEV capsid protein. In certain examples, the VLPs are comprised of E3, E2, 6K and E1. In other examples, the VLPs are comprised of capsid, E3, E2, 6K and E1. In various embodiments, the VLP comprises an alphavirus (CHIKV, WEEV, EEEV, VEEV, Ross River virus, Barmah Forest virus) capsid protein in which the nuclear localization sequence is altered. The alphavirus capsid protein nuclear localization sequence is altered in a charged residue (e.g., lysine or arginine), which is replaced with a non-charged residue (e.g., alanine or asparagine). In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A and/or K68N.

The invention also encompasses a vaccine formulation comprising VLPs that comprise at least one viral protein, an alphavirus E2 protein or a flavivirus envelope protein having a non-lysine residue (e.g., asparagine) at the amino acid position corresponding to amino acid 234 in the CHIKV E2 protein. The alphavirus E2 protein may have a modification at the amino acid position corresponding to amino acid 251 in the CHIKV E2 protein that destabilizes the E2 protein during viral budding. The alphavirus may be selected from the group consisting of, but not limited to, EEEV, WEEV, VEEV, SFV, CHIKV, O'nyong-nyong virus, Sindbis virus, Mayaro virus, Ross River virus, Barmah Forest virus, and Ockelbo virus.

In certain preferred embodiments, the vaccine composition comprises VLPs of CHIKV or WEEV, and a pharmaceutically acceptable carrier. In other certain preferred embodiments, the vaccine composition comprises VLPs of CHIKV or WEEV, an adjuvant, and a pharmaceutically acceptable carrier. In one embodiment, the vaccine comprises VLPs that contain a CHIKV or WEEV E2 alphavirus that has a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In another embodiment, the vaccine composition comprises VLPs containing additional CHIKV or WEEV envelope proteins, for example, the envelope proteins can be selected from the group consisting of E3, 6K, and E1. In another embodiment, the vaccine composition further comprises a CHIKV or WEEV capsid protein and a pharmaceutically acceptable carrier or excipient. In certain examples, the VLPs are comprised of E3, E2, 6K and E1. In other examples, the VLPs are comprised of capsid, E3, E2, 6K and E1.

Pharmaceutically acceptable carriers include but are not limited to saline, buffered saline, dextrose, water, glycerol, sterile isotonic aqueous buffer, and combinations thereof. A thorough discussion of pharmaceutically acceptable carriers, diluents, and other excipients is presented in Remington's Pharmaceutical Sciences (Mack Pub. Co. N.J. current edition). The formulation should suit the mode of administration. In a preferred embodiment, the formulation is suitable for administration to humans, preferably is sterile, non-particulate and/or non-pyrogenic.

The composition, if desired, can also contain minor amounts of wetting or emulsifying agents, or pH buffering agents. The composition can be a solid form, such as a lyophilized powder suitable for reconstitution, a liquid solution, suspension, emulsion, tablet, pill, capsule, sustained release formulation, or powder. Oral formulation can include standard carriers such as pharmaceutical grades of mannitol, lactose, starch, magnesium stearate, sodium saccharine, cellulose, magnesium carbonate, etc.

In certain embodiments, the VLP composition is supplied in liquid form, for example in a sealed container indicating the quantity and concentration of the VLP composition. Preferably, the liquid form of the VLP composition is supplied in a hermetically sealed container at least about 50 μg/ml, more preferably at least about 100 μg/ml, at least about 200 μg/ml, at least 500 μg/ml, or at least 1 mg/ml.

Generally, VLPs or DNA vaccines of the invention are administered in an effective amount or quantity (as described herein) sufficient to stimulate an immune response against one or more strains of a virus a described here, for example an alphavirus, e.g., CHIKV or WEEV, or a flavivirus. Preferably, administration of the VLP of the invention elicits immunity against a virus, for example an alphavirus, in particular example CHIKV or WEEV, or a flavivirus. Typically, the dose can be adjusted within this range based on, e.g., age, physical condition, body weight, sex, diet, time of administration, and other clinical factors. The prophylactic vaccine formulation is systemically administered, e.g., by subcutaneous or intramuscular injection using a needle and syringe, or a needle-less injection device. Alternatively, the vaccine formulation is administered intranasally, either by drops, large particle aerosol (greater than about 10 microns), or spray into the upper respiratory tract or small particle aerosol (less than 10 microns) or spray into the lower respiratory tract. While any of the above routes of delivery results in an immune response, intranasal administration confers the added benefit of eliciting mucosal immunity at the site of entry of many viruses, including alphaviruses, for example CHIKV or WEEV, or flaviviruses.

Thus, the invention also comprises a method of formulating a vaccine or antigenic composition that induces immunity to an infection or at least one symptom thereof to a mammal, comprising adding to said formulation an effective dose of VLPs, e.g., alphavirus (e.g., CHIKV or WEEV) or flavivirus VLPs. In one embodiment, the infection is an alphavirus infection, for example, but not limited to, EEEV, WEEV, VEEV, SFV, CHIKV, O'nyong-nyong virus, Sindbis virus, Mayaro virus, Ross River virus, Barmah Forest virus, and Ockelbo virus. In another embodiment, the infection is a flavivirus infection.

In certain cases, stimulation of immunity with a single dose is preferred, however additional dosages can be also be administered, by the same or different route, to achieve the desired effect. In neonates and infants, for example, multiple administrations may be required to elicit sufficient levels of immunity. Administration can continue at intervals throughout childhood, as necessary to maintain sufficient levels of protection against infections. Similarly, adults who are particularly susceptible to repeated or serious infections, such as, for example, health care workers, day care workers, family members of young children, the elderly, and individuals with compromised cardiopulmonary function or immune systems may require multiple immunizations to establish and/or maintain protective immune responses. Levels of induced immunity can be monitored, for example, by measuring amounts of neutralizing secretory and serum antibodies, and dosages adjusted or vaccinations repeated as necessary to elicit and maintain desired levels of protection.

Prime Boost

The present methods also include a variety of prime-boost regimens. In these methods, one or more priming immunizations is followed by one or more boosting immunizations. The actual immunogenic composition can be the same or different for each immunization and the type of immunogenic composition (e.g., containing protein or expression vector), the route, and formulation of the immunogens can also be varied.

For example, in one embodiment, the prime comprises administering a DNA or gene-based vaccine as described herein and the boost comprises administering a VLP as described herein. In another embodiment, the prime comprises administering a VLP as described herein and the boost comprises administering a DNA or other gene-based vaccine as described herein.

One useful prime-boost regimen provides for two priming immunizations, four weeks apart, followed by two boosting immunizations at 4 and 8 weeks after the last priming immunization. It should also be readily apparent to one of skill in the art that there are several permutations and combinations that are encompassed using the DNA, bacterial and viral expression vectors of the invention to provide priming and boosting regimens.

Methods of administering a composition comprising VLPs and/or DNA vaccines (vaccine and/or antigenic formulations) include, but are not limited to, parenteral administration (e.g., intradermal, intramuscular, intravenous and subcutaneous), epidural, and mucosal (e.g., intranasal and oral or pulmonary routes or by suppositories). In a specific embodiment, compositions of the present invention are administered intramuscularly, intravenously, subcutaneously, transdermally or intradermally. The compositions may be administered by any convenient route, for example by infusion or bolus injection, by absorption through epithelial or mucocutaneous linings (e.g., oral mucous, colon, conjunctiva, nasopharynx, oropharynx, vagina, urethra, urinary bladder and intestinal mucosa, etc.) and may be administered together with other biologically active agents. In some embodiments, intranasal or other mucosal routes of administration of a composition comprising VLPs of the invention may induce an antibody or other immune response that is substantially higher than other routes of administration. In another embodiment, intranasal or other mucosal routes of administration of a composition comprising VLPs of the invention may induce an antibody or other immune response that will induce cross protection against other strains of the virus. Administration can be intramuscular, subdermal, intraperitoneal. In one preferred embodiment, the administration is intramuscular.

In yet another embodiment, the vaccine and/or antigenic formulation is administered in such a manner as to target mucosal tissues in order to elicit an immune response at the site of immunization. For example, mucosal tissues such as gut associated lymphoid tissue (GALT) can be targeted for immunization by using oral administration of compositions which contain adjuvants with particular mucosal targeting properties. Additional mucosal tissues can also be targeted, such as nasopharyngeal lymphoid tissue (NALT) and bronchial-associated lymphoid tissue (BALT).

Vaccines and/or antigenic formulations of the invention may also be administered on a dosage schedule, for example, an initial administration of the vaccine composition with subsequent booster administrations. In particular embodiments, a second dose of the composition is administered anywhere from two weeks to one year, preferably from about 1, about 2, about 3, about 4, about 5 to about 6 months, after the initial administration. Additionally, a third dose may be administered after the second dose and from about three months to about two years, or even longer, preferably about 4, about 5, or about 6 months, or about 7 months to about one year after the initial administration. The third dose may be optionally administered when no or low levels of specific immunoglobulins are detected in the serum and/or urine or mucosal secretions of the subject after the second dose. In a preferred embodiment, a second dose is administered about one month after the first administration and a third dose is administered about six months after the first administration. In another embodiment, the second dose is administered about six months after the first administration. In another embodiment, said VLPs of the invention can be administered as part of a combination therapy. For example, VLPs of the invention can be formulated with other immunogenic compositions, antivirals and/or antibiotics. A VLP may be administered concurrently, subsequent to, or sequentially with another immunogenic composition, antiviral, antibiotic, or any other agent that prevents or treats an alphavirus infection (e.g., CHIKV or WEEV infection).

The dosage of the pharmaceutical formulation can be determined readily by the skilled artisan, for example, by first identifying doses effective to elicit a prophylactic or therapeutic immune response, e.g., by measuring the serum titer of virus specific immunoglobulins or by measuring the inhibitory ratio of antibodies in serum samples, or urine samples, or mucosal secretions. Said dosages can be determined from animal studies. A non-limiting list of animals used to study the efficacy of vaccines include the guinea pig, hamster, ferrets, chinchilla, mouse and cotton rat, and non-human primates. Most animals are not natural hosts to infectious agents but can still serve in studies of various aspects of the disease. For example, any of the above animals can be dosed with a vaccine candidate, e.g., VLPs of the invention, to partially characterize the immune response induced, and/or to determine if any neutralizing antibodies have been produced. For example, many studies have been conducted in the mouse model because mice are small size and their low cost allows researchers to conduct studies on a larger scale.

In addition, human clinical studies can be performed to determine the preferred effective dose for humans by a skilled artisan. Such clinical studies are routine and well known in the art. The precise dose to be employed will also depend on the route of administration. Effective doses may be extrapolated from dose-response curves derived from in vitro or animal test systems.

As also well known in the art, the immunogenicity of a particular composition can be enhanced by the use of non-specific stimulators of the immune response, known as adjuvants. Adjuvants have been used experimentally to promote a generalized increase in immunity against unknown antigens (e.g., U.S. Pat. No. 4,877,611). Immunization protocols have used adjuvants to stimulate responses for many years, and as such, adjuvants are well known to one of ordinary skill in the art. Some adjuvants affect the way in which antigens are presented. For example, the immune response is increased when protein antigens are precipitated by alum. Emulsification of antigens also prolongs the duration of antigen presentation. The inclusion of any adjuvant described in Vogel et al., "A Compendium of Vaccine Adjuvants and Excipients (2nd Edition)," herein incorporated by reference in its entirety for all purposes, is envisioned within the scope of this invention.

Exemplary adjuvants include complete Freund's adjuvant (a non-specific stimulator of the immune response containing killed *Mycobacterium tuberculosis*), incomplete Freund's adjuvants and aluminum hydroxide adjuvant. Other adjuvants comprise GMCSP, BCG, aluminum hydroxide, MDP compounds, such as thur-MDP and nor-MDP, CGP (MTP-PE), lipid A, and monophosphoryl lipid A (MPL). RIBI, which contains three components extracted from bacteria, MPL, trehalose dimycolate (TDM) and cell wall skeleton (CWS) in a 2% squalene/Tween-80 emulsion also is contemplated. MF-59, Novasomes®, MHC antigens may also be used.

The VLPs of the invention can also be formulated with "immune stimulators." These are the body's own chemical messengers (cytokines) to increase the immune system's response. Immune stimulators include, but not limited to, various cytokines, lymphokines and chemokines with immunostimulatory, immunopotentiating, and pro-inflammatory activities, such as interleukins (e.g., IL-1, IL-2, IL-3, IL-4, IL-12, IL-13); growth factors (e.g., granulocyte-macrophage (GM)-colony stimulating factor (CSF)); and other immunostimulatory molecules, such as macrophage inflammatory factor, Flt3 ligand, B7.1; B7.2, etc. The immunostimulatory molecules can be administered in the same formulation as the VLPs, or can be administered separately. Either the protein or an expression vector encoding the protein can be administered to produce an immunostimulatory effect. Thus in one embodiment, the invention comprises antigenic and vaccine formulations comprising an adjuvant and/or an immune stimulator.

Methods of Delivery

The VLPs of the invention are useful for preparing compositions that stimulate an immune response. Such compositions are useful for the treatment or prevention or an alphavirus infection (e.g., a CHIKV, WEEV, EEEV, VEEV, Ross River virus, or Barmah Forest virus infection) or a flavivirus. Both mucosal and cellular immunity may contribute to immunity to infectious agents and disease. In one embodiment, the invention encompasses a method of inducing immunity to an alphavirus infection, for example CHIKV, WEEV, EEEV, VEEV, Ross River virus, or Barmah Forest virus infection in a subject, by administering to the subject a CHIKV, WEEV, EEEV, VEEV, Ross River virus, or Barmah Forest virus VLP or a DNA vaccine. In another embodiment, the invention encompasses a method of inducing immunity to a flavivirus infection by administering to the subject a flavivirus VLP or a DNA vaccine.

The invention also provides a method to induce immunity to viral infection or at least one symptom thereof in a subject, comprising administering at least one effective dose of a VLP or DNA vaccine as described herein, for example a VLP comprising one or more viral proteins, for example one or more alphavirus or flavivirus virus envelope proteins, or a DNA vaccine comprising a nucleic acid segment encoding one or more alphavirus or flavivirus envelope proteins, or fragments thereof. In certain cases, the VLP further comprises an alphavirus or flavivirus capsid protein. In another embodiment, the method comprises inducing immunity to a viral infection, e.g., alphavirus or flavivirus infection, or at least one symptom thereof by administering said formulation in multiple doses.

VLPs of the invention can induce substantial immunity in a vertebrate (e.g., a human) when administered to said vertebrate. The substantial immunity results from an immune response against VLPs of the invention that protects or ameliorates infection or at least reduces a symptom of infection in said vertebrate. In some instances, if the said vertebrate is infected, said infection will be asymptomatic. The response may not be a fully protective response. In this case, if said vertebrate is infected with an infectious agent, the vertebrate will experience reduced symptoms or a shorter duration of symptoms compared to a non-immunized vertebrate.

In one embodiment, the invention comprises a method of inducing substantial immunity to alphavirus infection or at least one symptom thereof in a subject, comprising administering at least one effective dose of a VLP and/or a DNA vaccine comprising a nucleic acid segment encoding an alphavirus or flavivirus capsid protein or one or more alphavirus or flavivirus envelope proteins or fragments thereof, where the VLP has one or more alterations in an E2 protein and/or a alphavirus capsid protein Nuclear Localization Signal (NLS). In various embodiments, the VLP includes an envelope protein having a non-lysine residue (e.g., asparagine) at the amino acid position corresponding to amino acid 234 in the CHIKV E2 protein and/or a modification at the amino acid position corresponding to amino acid 251 in the CHIKV E2 protein that destabilizes the E2 protein during viral budding. In particular embodiments, the infection is CHIKV or WEEV and the VLP comprises one or more CHIKV or WEEV envelope proteins as described herein. In another embodiment, the invention comprises a method of vaccinating a mammal against an alphavirus comprising administering to said mammal a protection-inducing amount of VLPs or DNA vaccines comprising at least one alphavirus protein. In one embodiment, said method comprises administering DNA vaccines comprising alphavirus capsid, E3, E2, 6K and E1. In another embodiment, said method comprises administering DNA vaccines comprising alphavirus E3, E2, 6K and E1. In another embodiment, said method comprises administering DNA vaccines comprising C-$Env_{37997}$. In another embodiment, said method comprises administering DNA vaccines comprising $Env_{37997}$. In another embodiment, said method comprises administering DNA vaccines comprising CMV/R CHIKV C-E3-E2-6K-E1 (strain OPY1) E2 K234N. In another embodiment, said method comprises administering DNA vaccines comprising CMV/R WEEV C-E3-E2-6K-E1 (strain 71V-1658) E2 K235N. In another embodiment, said method comprises administering DNA vaccines comprising VLPC-E2(37997). In another embodiment, said method comprises administering DNA vaccines comprising VLPOPY-1 E2(37997). In one embodiment, said method comprises administering VLPs comprising alphavirus capsid, E3, E2, 6K, and E1. In another embodiment, said method comprises administering VLPs comprising alphavirus E3, E2, 6K, and E1. In one embodiment, said method comprises administering VLPs comprised of CHIKV or WEEV envelope proteins. In various embodiments, the VLP comprises an alphavirus (CHIKV, WEEV, EEEV, VEEV, Ross River virus, Barmah Forest virus) capsid protein in which the nuclear localization sequence is altered. The alphavirus capsid protein nuclear localization sequence is altered in a charged residue (e.g., lysine or arginine), which is replaced with a non-charged residue (e.g., alanine or asparagine). In specific embodiments, the alphavirus capsid protein is a WEEV CBA87 strain capsid protein having one or more of the alterations K67N, K68N, and/or K69N. In certain embodiments, the alphavirus capsid protein is a VEEV TC83 strain capsid protein having one or more of the alterations K64N, K65A, K65N, K67A, and/or K67N. In some embodiments, the alphavirus capsid protein is a EEEV PE-6 strain capsid protein having an alteration K67N. In particular embodiments, the alphavirus capsid protein is a CHIKV(Strain 37997) strain capsid protein having one or more of the alterations R62A, R63A, R65A, K66A, K68A, and/or K69A. In specific embodiments, the alphavirus capsid protein is a Ross River Virus capsid protein having one or more of the alterations R71N, K72N, K73N, and/or K74N. In specific embodiments, the alphavirus capsid protein is a Barmah Forest Virus capsid protein having one or more of the alterations K64A, K64N, K65A, K65N, K67A, K67N, K68A and/or K68N.

In another embodiment, the invention comprises a method of vaccinating a mammal against a flavivirus comprising administering to said mammal a protection-inducing amount of VLPs or DNA vaccines comprising at least one flavivirus protein. In another embodiment, said method comprises administering VLPs comprising flavivirus envelope protein. In another embodiment, said method comprises administering VLPs comprising flavivirus capsid protein.

In another embodiment, the invention comprises a method of inducing a protective cellular response to a viral infection or at least one symptom thereof in a subject, comprising administering at least one effective dose of a DNA vaccine or a VLP.

As mentioned above, the VLPs of the invention prevent or reduce at least one symptom of an infection in a subject. A reduction in a symptom may be determined subjectively or objectively, e.g., self assessment by a subject, by a clinician's assessment or by conducting an appropriate assay or measurement (e.g., body temperature), including, e.g., a quality of life assessment, a slowed progression of viral infection or additional symptoms, a reduced severity of viral symptoms or a suitable assays (e.g., antibody titer and/or T-cell activation assay). The objective assessment comprises both animal and human assessments.

The invention also provides assays to identify inhibitors of viral entry comprising, in at least one embodiment, genetically modified target cells expressing at least one alphavirus (e.g., CHIKV or WEEV) or flavivirus viral receptor, together with any co-receptors which might be required for infection or entry. These cells are genetically modified in the sense that they express a reporter gene, such as an affinity tag, a fluorogenic protein or an enzyme able to convert substrates into fluorogenic, chromogenic or luminometric products. Coupling this type of reporter signal to an inhibition of viral infection is accomplished by arranging the expression of the reporter gene to be strongly decreased (downregulated) upon infection with the virus of interest. In principle, this can be ensured by any suitable means, but especially preferred are:

The reporter gene product itself is fused to a cellular protein which, upon infection with the virus of interest is itself downregulated. For example, the reporter gene product can be fused to the corresponding viral receptor, which in many cases is downregulated upon infection.

Thus in one aspect a compound library may be screened for the ability to inhibit the infection of cells with alphavirus (e.g., CHIKV, WEEV, EEEV, VEEV, Ross River virus, or Barmah Forest virus) or flavivirus. An appropriate indicator cell line is generated that stably expresses a reporter gene. In one example, these cells are seeded in microtiter plates and incubated with alphavirus (e.g., CHIKV, WEEV, EEEV, VEEV, Ross River virus, or Barmah Forest virus) or flavivirus particles in the presence of different compounds, e.g., antibodies, in each well. Upon infection, the fusion protein is downregulated due to the expression of the viral genes. Consequently, only cells that have not been infected with CHIKV will express the reporter gene. Thus, wells that exhibit a positive reporter signal contain compounds that inhibit infection. Variations and modifications of these assays will be apparent from the relevant sections of the description which explain individual parts of the assay in more detail. Specifically, in one embodiment, the reporter gene can be expressed when infection occurs rather than the reporter gene being downregulated upon infection. In further embodiments, the viral particles are pseudotyped viral particles comprising one or more envelope protein and, optionally, the capsid protein from alphavirus (e.g., CHIKV, WEEV, EEEV, VEEV, Ross River virus, or Barmah Forest virus) or flavivirus.

In another embodiment, the invention provides methods for identifying inhibitors of viral entry using a reporter gene system as exemplified herein. Briefly, the invention provides recombinant lentiviral vectors expressing a reporter gene. Cells are incubated and co-transfected with an expression vector, e.g., $Env_{OPY-1}$, and a reporter plasmid using a standard techniques.

Cells are plated into one day prior to infection. Alphavirus or flavivirus Env-pseudotyped lentiviral vectors encoding the reporter gene are first titrated by serial dilution. Similar amounts of pseudotyped vectors are then incubated with the candidate inhibitors prior to adding the virus. Cells are then lysed using cell lysis buffer and the reporter gene activity is measured Inhibitors of viral entry are identified based on the expression of the reporter gene.

Kits

The invention also provides for a pharmaceutical pack or kit comprising one or more containers filled with one or more of the ingredients of the vaccine formulations of the invention. In a preferred embodiment, the kit comprises two containers, one containing VLPs and the other containing an adjuvant. Associated with such container(s) can be a notice in the form prescribed by a governmental agency regulating the manufacture, use or sale of pharmaceuticals or biological products, which notice reflects approval by the agency of manufacture, use or sale for human administration.

The invention also provides that the VLP formulation be packaged in a hermetically sealed container such as an ampoule or sachette indicating the quantity of composition. In one embodiment, the VLP composition is supplied as a liquid, in another embodiment, as a dry sterilized lyophilized powder or water free concentrate in a hermetically sealed container and can be reconstituted, e.g., with water or saline to the appropriate concentration for administration to a subject.

The invention also features a kit comprising a VLP as described herein. The invention also features kits comprising a DNA vaccine as described herein and instructions for use.

The invention also features a kit comprising a VLP in a first container and a DNA vaccine in a second container, and instructions for use in a prime boost immunization.

The following examples are offered by way of illustration, not by way of limitation. While specific examples have been provided, the above description is illustrative and not restrictive. Any one or more of the features of the previously described embodiments can be combined in any manner with one or more features of any other embodiments in the present invention. Furthermore, many variations of the invention will become apparent to those skilled in the art upon review of the specification. The scope of the invention should, therefore, be determined not with reference to the above description, but instead should be determined with reference to the appended claims along with their full scope of equivalents.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1

Figure 5:
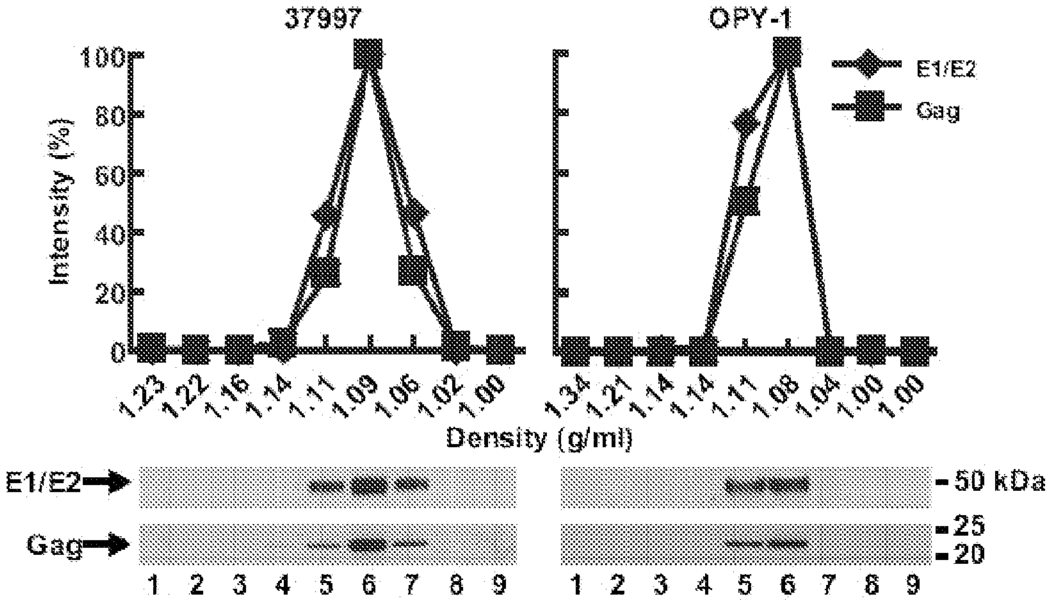
FIG. 5 shows the characterization of CHIKV E pseudotyped lentiviral vectors by buoyant density sedimentation and Western blot analysis. Plasmids encoding the indicated CHIKV Env strains were cotransfected with lentiviral expression vectors into 293T cells. Forty-eight hours after transfection, supernatants were harvested and run on sedimentation gradients as described previously. Quantification of gradient fractions is shown with the indicated strains, showing colocalization of Env with the Gag fraction of the expected buoyant density for lentiviral particles (1.08-1.1 g/ml) (upper panel). Western blot analysis of gradient fractions for CHIKV E1/E2 and Gag are shown (lower panel).
Figure 6:
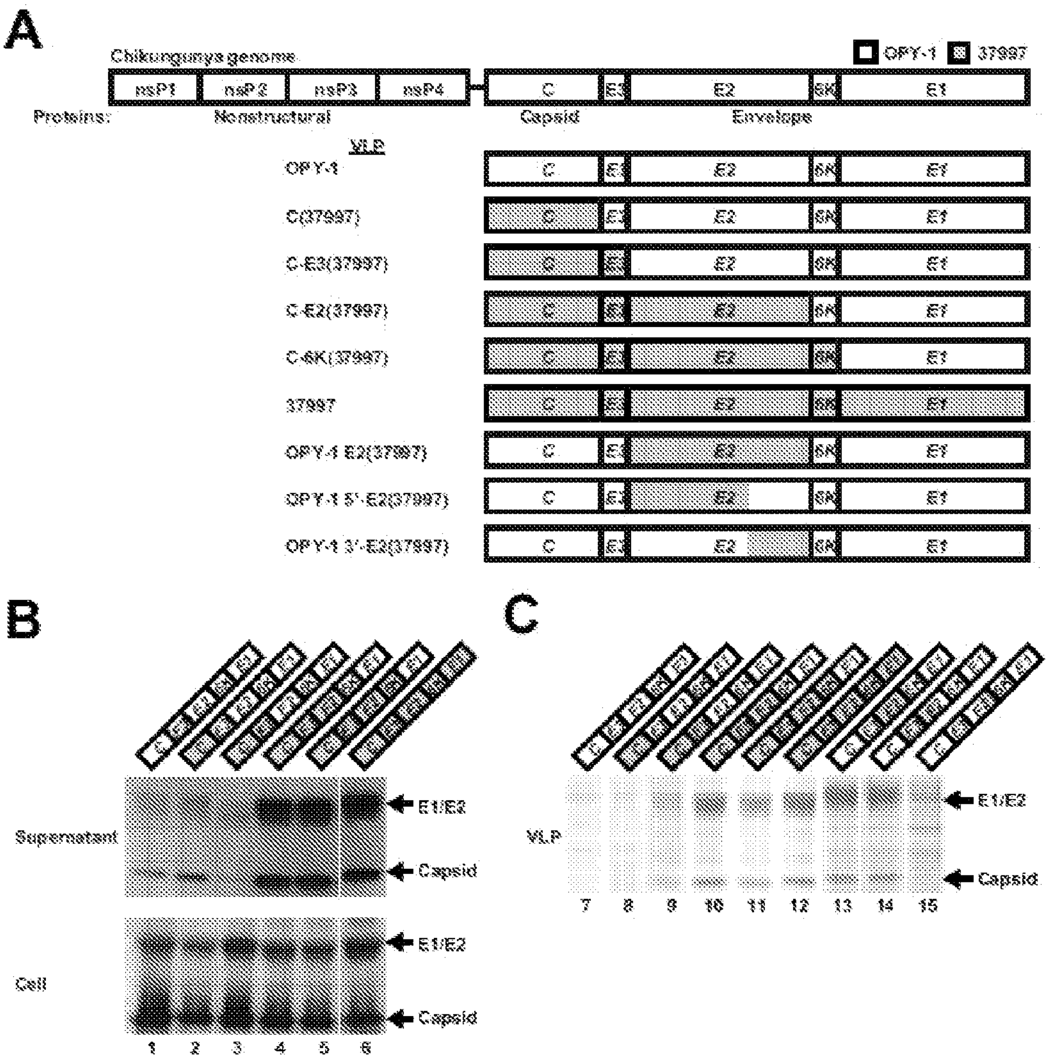
FIG. 6A-6C show the schematic representation of plasmid expression vectors and characterization of chimeric CHIKV and WEEV VLPs.

Lentiviral Vectors Pseudotyped with CHIKV Envelope Mediated Entry Through the Same Mechanism as Wild Type Virus To examine the mechanism and specificity of CHIKV cell entry, lentiviral vector reporters were pseudotyped with glycoproteins from different CHIKV strains that mediate entry into permissive cells. The CHIKV spike on the virion surface is formed by three E1-E2 heterodimers, where E1 glycoproteins mediate fusion and E2 glycoproteins interact with the host receptor. CHIKV E genes expressing the native polypeptide, E3-E2-6K-E1 polyprotein, for the 37997 and for LR2006 OPY-1 strains were inserted into an expression vector (E37997 and EOPY-1) (FIG. 1A, FIGS. 6, 7A, 7B, and 8A-8C). The incorporation of the two CHIKV Es into the pseudotyped lentiviral vectors was verified by buoyant density gradient sedimentation of the virus. Both CHIKV E and HIV-1 Gag had the same buoyant density as lentivirus particles (FIG. 5). The 37997 and LR2006 OPY-1 CHIKV pseudotyped lentiviral vectors infected several permissive cell lines (Sourisseau et al., *PLoS. Pathog.* 3, e89 (2007)) as measured by luciferase reporter activity, while a control devoid of CHIKV envelope proteins did not infect these cell lines (FIG. 1B, left), and infectivity was dose-dependent (FIG. 1B, right).

To determine whether entry occurred through the same mechanism as native virus, the pH and endosome dependence of entry was analyzed as described previously (Yang et al., *J. Virol.* 78, 5642 (2004)). CHIKV infects cells through a process of pH-dependent cell fusion. Thus, addition of ammonium chloride or chloroquine, which prevents acidification of the endosome, caused a dose-dependent reduction in CHIKV pseudotyped vector entry (FIG. 1C). Similar inhibition of entry was observed with VSV-G, known to enter in this fashion, but not with amphotropic murine leukemia virus (MuLV) glycoprotein 70, which enters in a pH-independent fashion. These findings demonstrated that lentiviral vectors pseudotyped with CHIKV envelope mediated entry through the same mechanism as wild type virus. Sera from mice injected with a CHIKV strain were next examined. Incubation of immune sera with the CHIKV pseudotyped lentiviral vector but not VSV-G pseudotyped vector inhibited entry (FIG. 1D). The specificity and potency of neutralizing antibodies could therefore be quantified without exposure to infectious virus.

Example 2

VLPs have Morphology of Wild Type Virus

CHIKV encodes 4 nonstructural proteins, NS1, NS2, NS3 and NS4, which are involved in virus replication, and 5 structural proteins, which consist of capsid (C) and envelope proteins (E; E1, E2, E3 and 6K) that are synthesized as polyproteins and are cleaved by capsid autoproteinase and signalases (Strauss, *Microbiol. Rev.* 58, 491 (1994)). Eukaryotic expression vectors encoding C-E3-E2-6K-E1 from strains 37997 and LR2006 OPY-1 (C-E37997 and C-EOPY-1) were analyzed for their ability to give rise to VLP. The plasmids C-E37997 or C-EOPY-1 or the expression vectors described above, E37997 or EOPY-1 (FIG. 2A, upper panel), were transfected into human embryonic kidney (293T) cells, and expression was confirmed by Western blotting (FIG. 2A, lower panel). C and E1/E2 proteins were detected in the supernatant after transfection of the C-E37997 or C-EOPY-1 vector, suggesting that CHIKV VLPs had been generated. VLPs were purified by buoyant density gradient sedimentation. The yield of VLPs from strain 37797 was 10-20 mg/L, approximately 100 times higher than that from strain LR2006 OPY-1; strain 37997 was therefore chosen for further VLP characterization and development. Fractionation of clarified supernatant showed peak incorporation of E1/E2 at a density of 1.2 g/ml (FIG. 2B, left), comparable to the density of wild type CHIKV. Examination of the purified fraction from strain 37997 by electron microscopy revealed VLPs with the same morphologic appearance as wild type virus (FIG. 2B, right).

Figure 2:
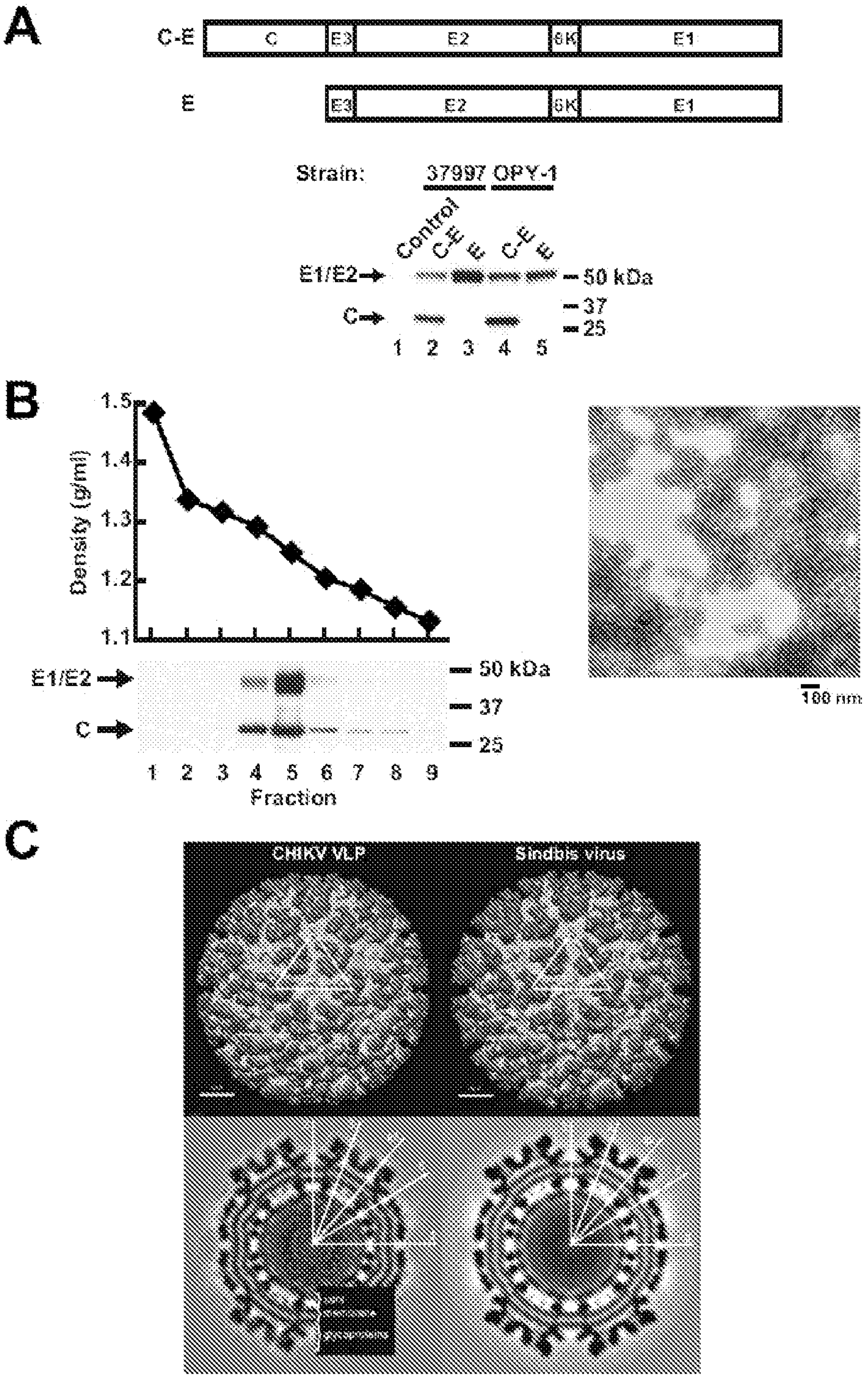
FIGS. 2A-2C show the schematic representation of plasmid expression vectors and characterization of CHIKV VLPs.

Cryoelectron microscopy and three dimensional image reconstruction assuming icosahedral symmetry showed that the VLPs had an external diameter of 65 nm and a core diameter of 40 nm (FIG. 2C, left). The potent immunogenic E1/E2 glycoproteins are organized into 240 heterodimers, assembled into 80 glycoprotein spikes arranged with T=4 quasi symmetry on the surface of the VLPs (FIG. 2C, left), closely similar to the structure of Sindbis virus (FIG. 2C, right). In addition, the organization of the nucleocapsid core is also remarkably similar to that of other alphaviruses.

Example 3

Figure 3:
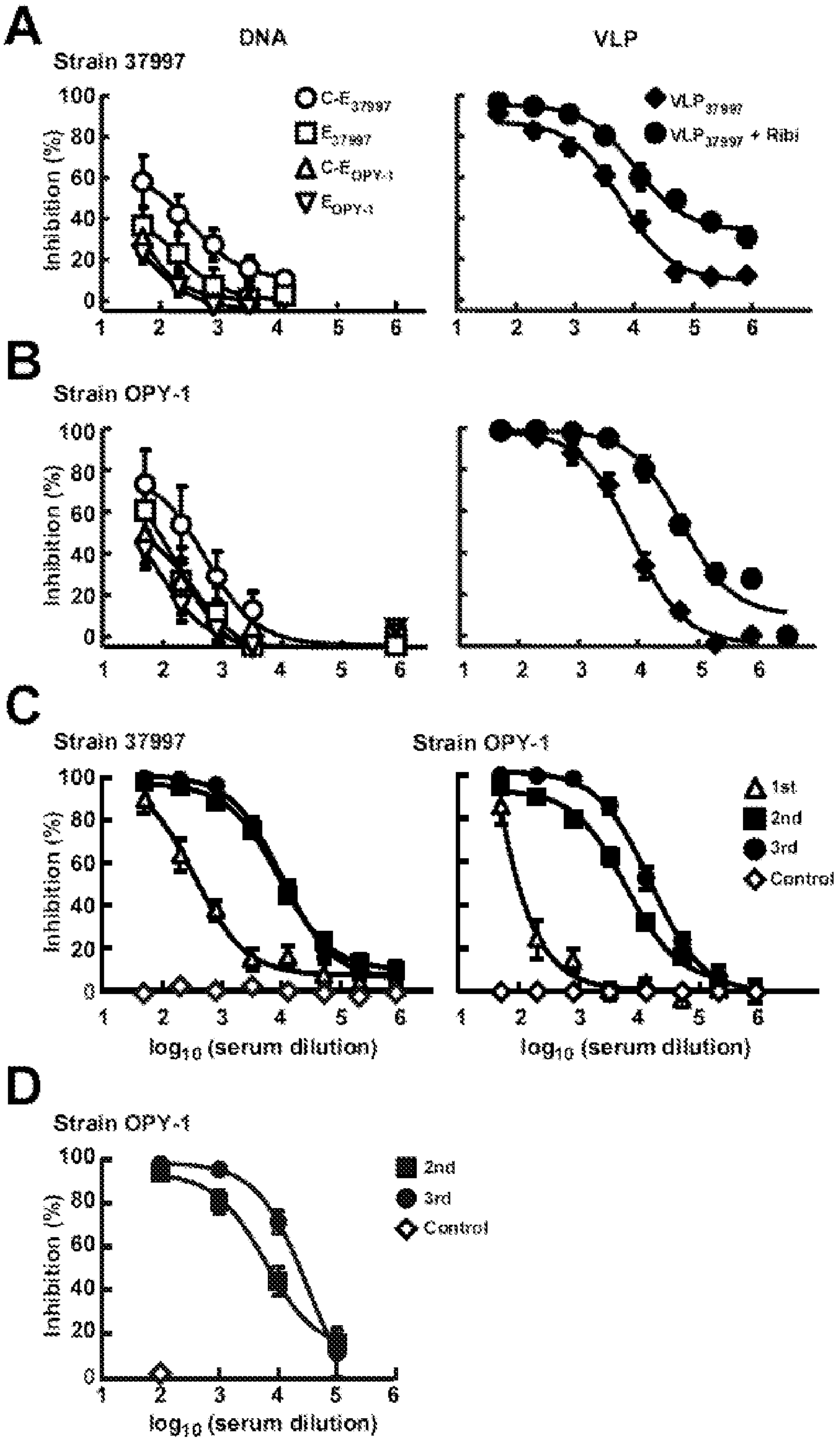
FIGS. 3A-3D are graphs showing the neutralization of CHIKV strains 37997 and LR2006 OPY-1 after DNA or VLP vaccination in mice and monkeys. Sera from immunized mice 10 days after the final immunization were tested with CHIKV strain 37997 (FIG. 3A) or LR2006 OPY-1 (FIG. 3B) E pseudotyped lentiviral vectors. Mice were immunized with the indicated DNA or $VLP_{37997}$. Each C-E or E (strain 37997 and LR2006 OPY-1, respectively) plasmid was injected at 0, 3 and 6 weeks. $VLP_{37997}$ with or without Ribi adjuvant was injected at 2 and 6 weeks. The experiment was performed in triplicate. The symbols show the average of the five mice and bars show the standard error of the mean. The curve fit was calculated by Prism software.

VLPs Induced a More Potent Neutralizing Antibody Response to CHIKV than DNA Vaccines The immunogenicity of DNA and VLP vaccines was determined in mice immunized with DNA vaccines encoding C-E or E (strains 37997 and LR2006 OPY-1) or VLPs from strain 37997 (VLP37997) in the presence or absence of Ribi adjuvant. Mice injected with VLPs with adjuvant generated the highest titer neutralizing responses against both the homologous strain 37997 (FIG. 3A, right panel; IC50, 1:10,703) and the heterologous strain LR2006 OPY-1 (FIG. 3B, right panel; IC50, 1:54,600). While immunization with the plasmids encoding C-E and E from both strains elicited neutralizing responses, these responses were 100-fold lower than the VLP-immunized mice (FIG. 3A, B; left panel). These results indicate that VLPs elicited a more potent neutralizing antibody response than DNA vaccines.

To characterize VLP-induced immune responses in a model with strong predictive value for humans, rhesus macaques were immunized with VLPs. Monkeys were injected with VLP37997 or PBS alone as a control. Sera from immunized and control monkeys were tested against CHIKV strain 37997 and LR2006 OPY-1 pseudotyped lentiviral vectors. All non-human primates (NHP) immunized with VLPs developed substantial neutralizing activity to both homologous and heterologous strains after primary immunization that increased after boosting (FIG. 3C; left panel: strain 37997, right panel: strain LR2006 OPY-1). To confirm that these antibodies neutralized infectious virus, a plaque reduction neutralization test (PRNT) was performed against the CHIKV LR2006 OPY-1. The antisera from the immunized monkeys elicited neutralizing antibody responses against LR2006 OPY-1 at titers that exceeded 1:40,000 (FIG. 3D). These data suggested that neutralizing antibodies using pseudotyped lentiviral vectors correlated with the PRNT assay, and that all immunized monkeys generated potent neutralizing antibody responses against CHIKV.

Example 4

Figure 4:
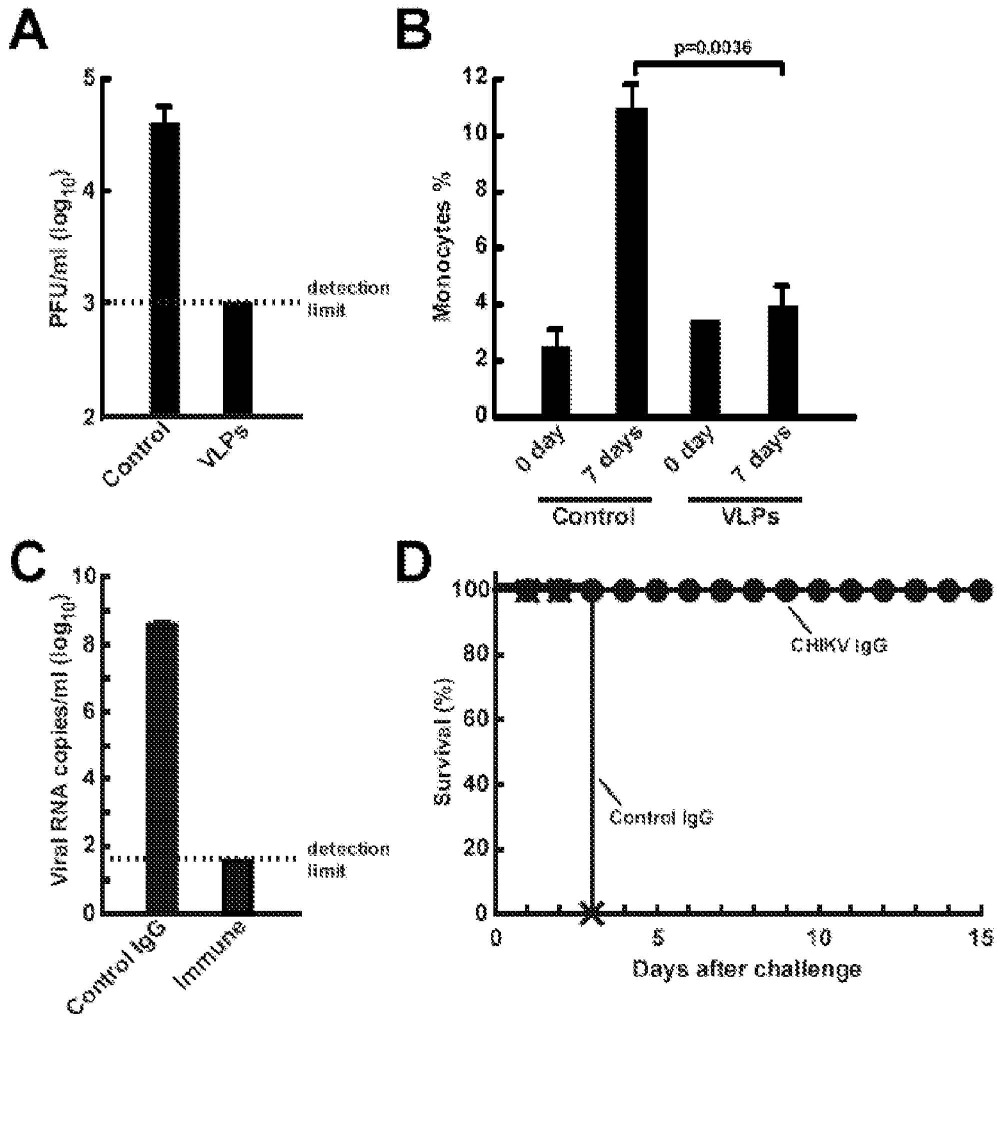
FIGS. 4A-4D are graphs showing protection against CHIKV LR2006 OPY-1 challenge in monkeys immunized with VLPs and in a CHIKV mouse model after passive transfer of purified IgG.

Primate VLP Immunization Protected Against Viremia and Inflammatory Consequences of CHIKV Infection The ability of the VLP vaccine to protect against infection was determined by intravenous challenge of monkeys immunized with VLPs or controls using a high titer LR2006 OPY-1 virus stock 15 weeks after the final immunization. Similar to humans, infection in the NHP resulted in non-lethal viremia and a pro-inflammatory response as measured by an increase in monocyte counts. The control monkeys showed viremia beginning at 6 hours and lasting until 72 hours after challenge, while all of the immunized monkeys controlled the challenge virus completely (FIG. 4A). Similarly, the monocyte counts in control monkeys increased markedly relative to vaccinated monkeys by 4 days after challenge (FIG. 4B, Control vs. VLPs; p=0.0036). These data indicated that immunization protected against viremia as well as the inflammatory consequences of infection. To define the mechanism of protection in these animals, the question of whether immune IgG could protect against lethal challenge was examined using an adoptive transfer model.

Example 5

Humoral Immune Responses Induced by CHIKV VLPs Conferred Protection Against CHIKV Infection Previous studies have shown that immunodeficient mice with defective type-I IFN signaling developed severe infection, displaying symptoms and tissue tropism analogous to humans, and providing a model to evaluate immune mechanisms of protection. Purified total IgG from immune or control monkeys was passively transferred into these mice. The recipient mice were challenged intradermally 24 hours after IgG transfer with a lethal dose of LR2006 OPY-1. Recipients of purified CHIKV immune IgG demonstrated no detectable viremia after infection and were completely protected from lethality (FIGS. 4C, D). In contrast, all mice that received purified IgG from control monkeys showed severe infection and viremia, and all died. These results indicate that humoral immune responses induced by CHIKV VLPs conferred protection against CHIKV infection.

Example 6

Importance of Amino Acid 234 in the E2 Protein of CHIKV in VLP Production

Although the two strains are highly related, with 95% amino acid similarity between the sequences of the structural genes, VLPs are produced efficiently by the CHIKV 37997 strain, but yields of VLPs from the OPY-1 strain are very low. In order to understand the mechanism underlying the difference in VLP production between the CHIKV strains, genes between the 37997 and the OPY-1 strains were swapped and VLP production was assessed. Specifically, using the C-E3-E2-6K-E1 expression vector, either capsid (C) alone, C-E3, C-E3-E2, or C-E3-E2-6K regions from $CHIKV_{37997}$ was inserted into the expression vector using an overlap extension PCR method.

The chimeric genes between 37997 and OPY-1 strains were amplified using the primers shown in Table 1.

TABLE 1

| Chimeric VLP expression vector primers (SEQ ID NOS 8-57, respectively, in order of appearance) | |
|---|---|
| CHIKV 37997 F | CTCTAGACACCATGGAGTTCATCCC |
| CHIKV 37997 R | TGGATCCTCATTAGTGCCTGCTAAACGACA |
| CHIKV OPY-1 F | ATATCGCGGCCGCTCTAGAC |
| CHIKV OPY-1 R | TGGATCCTCATTAGTGCCTGCTGAACGACA |
| CHIKV $VLP_{C(37997)}$ F | TACCCCTGAGGGAGCCGAAGAGTGGAGTCTTGCCATCCCAGTTATGTGCC |
| CHIKV $VLP_{C(37997)}$ R | CCACTCTTCGGCTCCCTCAGGGGTAA |
| CHIKV $VLP_{C\text{-}E3(37997)}$ F | TTGCTCTCCCCACCGCCAAAGACGCAGCACCAAGGACAACTTCAATGTCT |
| CHIKV $VLP_{C\text{-}E3(37997)}$ R | GCGTCTTTGGCGGTGGGGAGAGCAA |
| CHIKV $VLP_{C\text{-}E2(37997)}$ F | ATGCTGCGTCAGAACGACCAAGGCGGCCACATACCAAGAGGCTGCGATAT |
| CHIKV $VLP_{C\text{-}E2(37997)}$ R | CGCCTTGGTCGTTCTGACGCAGCAT |
| CHIKV $VLP_{C\text{-}6K(37997)}$ F | CATCGGTGCCCACACTGTGAGCGCGTACGAACACGTAACAGTGATCCCGA |
| CHIKV $VLP_{C\text{-}6K(37997)}$ R | CGCGCTCACAGTGTGGGCACCGATG |
| CHIKV $VLP_{OPY\text{-}1\ E2(37997)}$ F | ATATCGCGGCCGCTCTAGAC |
| CHIKV $VLP_{OPY\text{-}1\ E2(37997)}$ R | GCGTCGCTGGCGGTGGGGAGAACAT |
| CHIKV $VLP_{OPY\text{-}1\ E2(37997)}$ F | ATGTTCTCCCCACCGCCAGCGACGCAGTACTAAGGACAATTTTAATGTCT |
| CHIKV $VLP_{OPY\text{-}1\ E2(37997)}$ R | TGGATCCTCATTAGTGCCTGCTGAA |
| CHIKV $VLP_{OPY\text{-}1\ 5'\text{-}E2(37997)}$ F | CCATGCTGCTGTATCCTGACCACCCAACACTCCTGTCCTA |
| CHIKV $VLP_{OPY\text{-}1\ 5'\text{-}E2(37997)}$ R | TAGGACAGGAGTGTTGGGTGGTCAGGATACAGCAGCATGG |
| CHIKV $VLP_{OPY\text{-}1\ 3'\text{-}E2(37997)}$ F | TCATGCTACTGTATCCTGACCATCCGACACTCTTGTCTTA |
| CHIKV $VLP_{OPY\text{-}1\ 3'\text{-}E2(37997)}$ R | TAAGACAAGAGTGTCGGATGGTCAGGATACAGTAGCATGA |
| Mutagenesis primers | |
| CHIKV I32V | CATTCGTGCCACAGCCCTGTCGCATTGGAGC |
| CHIKV I32V_antisense | GCTCCAATGCGACAGGGCTGTGGCACGAATG |
| CHIKV S72N | ACCAAGCTGCGCTATATGGATAACCATACGCCAGC |
| CHIKV S72N_antisense | GCTGGCGTATGGTTATCCATATAGCGCAGCTTGGT |
| CHIKV T74M | TGCGCTATATGGATAGCCATATGCCAGCGGACG |
| CHIKV T74M_antisense | CGTCCGCTGGCATATGGCTATCCATATAGCGCA |
| CHIKV L84F | GGAGCGAGCCGGATTGTTTGTAAGGACTTCAGC |
| CHIKV L84F_antisense | GCTGAAGTCCTTACAAACAATCCGGCTCGCTCC |
| CHIKV T124S | CAGAAAGATCAGCCACTCATGCACACACCCGTT |
| CHIKV T124S_antisense | AACGGGTGTGTGCATGAGTGGCTGATCTTTCTG |
| CHIKV E132D | CACACACCCGTTCCATCATGATCCACCTGTGATA |
| CHIKV E132D_antisense | TATCACAGGTGGATCATGATGGAACGGGTGTGTG |
| CHIKV R140K | GTGATAGGTAGGGAGAAGTTCCACTCTCGACCA |

TABLE 1-continued

Chimeric VLP expression vector primers (SEQ ID NOS 8-57, respectively, in order of appearance)

| | |
|---|---|
| CHIKV R140K_antisense | TGGTCGAGAGTGGAACTTCTCCCTACCTATCAC |
| CHIKV A164T | GCACCGCTGCCACTACTGAGGAGATAGAG |
| CHIKV A164T_antisense | CTCTATCTCCTCAGTAGTGGCAGCGGTGC |
| CHIKV T182S | CCGCACGCTGATGTCGCAGCAGTCTGG |
| CHIKV T182S_antisense | CCAGACTGCTGCGACATCAGCGTGCGG |
| CHIKV I222V | AAGTGATCAATAACTGCAAAGTTGATCAGTGCCATG CTGC |
| CHIKV I222V_antisense | GCAGCATGGCACTGATCAACTTTGCAGTTATTGATC ACTT |
| CHIKV N234K | GCTGCAGTCACTAATCACAAGAAGTGGCAATACAAC TC |
| CHIKV N234K_antisense | GAGTTGTATTGCCACTTCTTGTGATTAGTGACTGCAG C |
| CHIKV T284I | CGGAAAAAACCAAGTCATCATGCTGCTGTATCCTG |
| CHIKV T284I_antisense | CAGGATACAGCAGCATGATGACTTGGTTTTTTCCG |
| CHIKV OPY-1 K234N | CCGCGGTCACCAATCACAAAAATTGGCAGTATAAC |
| CHIKV OPY-1 K234N_antisense | GTTATACTGCCAATTTTTGTGATTGGTGACCGCGG |
| WEEV K235N | CTACAAGAGCGACCAAACGAATTGGGTCTTCAACTC |
| WEEV K235N_antisense | GAGTTGAAGACCCAATTCGTTTGGTCGCTCTTGTAG |
| CHIKV OPY-1 K233N | GCCGCGGTCACCAATCACAATAAGTGGCAGTA |
| CHIKV OPY-1 K233N_anti | TACTGCCACTTATTGTGATTGGTGACCGCGGC |

Briefly, two fragments of the chimeric genes were amplified with 40 to 51 base pairs of primers that overlapped by 20 oligonucleotides and either of CHIKV 37997 F, CHIKV 37997 R, CHIKV OPY-1 F, or CHIKV OPY-1 R primers. These two fragments were assembled in the overlapping region and amplified again with CHIKV 37997 F, CHIKV 37997 R, CHIKV OPY-1 F, or CHIKV OPY-1 R primers. The PCR products were cloned into the C-EOPY-1 expression vector after confirming the sequence. Chimeric CHIKV were made using the PCR-based Quickchange (Stratagene, La Jolla, Calif.) method according to the manufacturer's instructions with sense and anti-sense primers shown in Table 1. The OPY-1 genes of either the capsid alone, the capsid to E3, the capsid to E2 or the capsid to 6K were replaced with the corresponding genes from 37997 ($VLP_{C(37997)}$, $VLP_{C-E3(37997)}$, $VLP_{C-E2(37997)}$ or $VLP_{C-6K(37997)}$). Each mutant was confirmed by sequencing, and the chimeric CHIKV expression vectors are depicted in FIG. 6A.

293F cells were transfected with these plasmids and the expression of CHIKV structural proteins and yield of VLPs in the supernatant and cell lysate were determined using Western blot analysis (FIG. 6B). Expression of capsid and E1/E2 in cell lysates was similar for all of the plasmids, but VLP release in supernatants was significantly different (FIG. 6B). Notably, the yield of OPY-1 VLP increased when the 37997 strain E2 region was included in the vector (FIG. 6B, lane 4, upper panel). To determine which region was responsible for this increase, the different polypeptide regions of 37997 were inserted into the OPY-1 expression vector. This analysis revealed that the E2 region alone was responsible for increased VLP production. Replacement of E2 enhanced VLP as determined by Commassie blue staining of sucrose density sedimentation purified particles (FIG. 6C, lane 13). To map the subregion responsible for this effect, chimeras that further subdivided E2 were prepared. The $NH_2$-terminal E2 domain (E2 1-290 a.a.) or the COOH-terminal E2 domain (E2 291-423 a.a.) was replaced in the $VLP_{OPY-1}$ expression vector. VLP production in transfected cells revealed that the $NH_2$-terminal region (1-290 a.a.) was necessary and sufficient for efficient VLP synthesis (FIG. 6C, lane 14).

Figure 7:
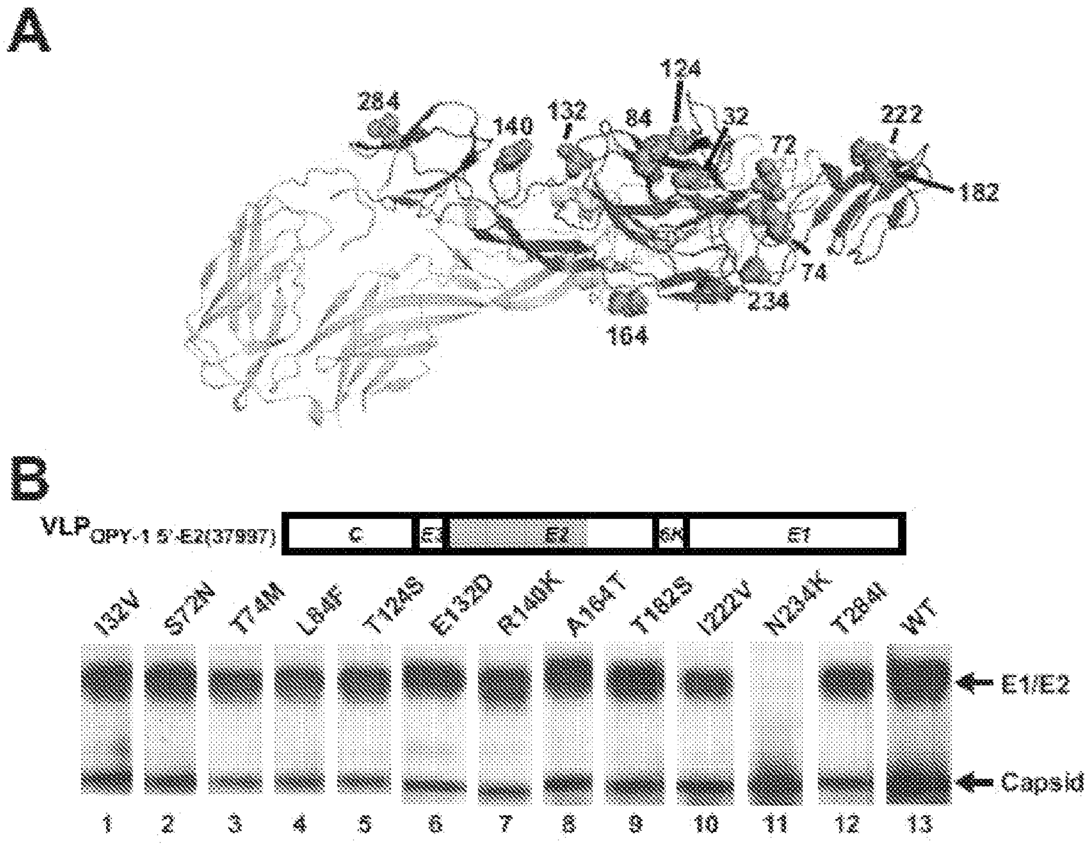
FIGS. 7A and 7B show structural models for CHIKV OPY-1 E1/E2 compared to the CHIKV E2 37997 sequence, and the effect of the single amino acid mutation, N234K on CHIKV VLP production.

The sequences of 37997 and OPY-1 differed in this region by twelve amino acids (FIG. 7A). To determine which amino acids were critical for VLP generation, site-specific mutations were introduced individually at these sites. Eleven of the twelve mutants synthesized VLPs at levels similar to the $NH_2$-terminal chimeric E2 expression vector (WT) (FIG. 7B). In contrast, the N234K mutation from OPY-1 abolished VLP release (FIG. 7B, lane 11), indicating that this amino acid residue played a critical role in the regulation of VLP synthesis.

Figure 8:
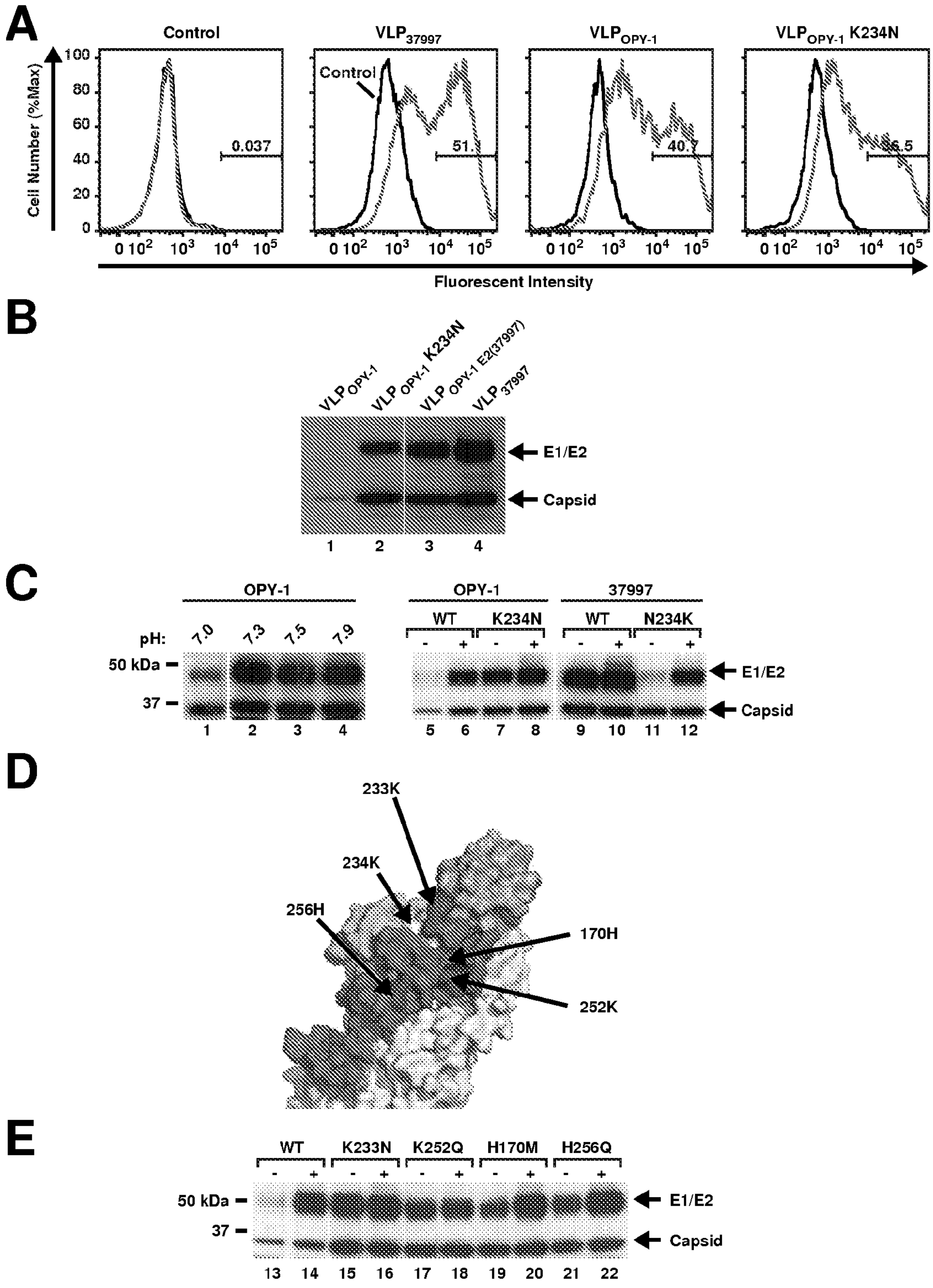
FIGS. 8A-8E show the effect of pH and amino acid mutations in the E2 ASR on VLP production.

To determine whether modification of amino acid residue 234 from strain 37997 could improve VLP yield, this site was mutated from K to N in the OPY-1 expression vector ($VLP_{OPY-1}$ K234N). Though expression of envelope from $VLP_{OPY-1}$ K234N on the cell surface was similar to that of $VLP_{OPY-1}$ (FIG. 8A), VLP release was increased by 86-fold compared to the parental OPY-1 expression vector (FIG. 8B). It was hypothesized that $VLP_{OPY-1}$ has a role in pH-dependent VLP yield, and that the $VLP_{OPY-1}$ K234N mutant is insensitive to pH. To test this hypothesis, the yield of VLP mutants was compared at pH 7.0 (wt), 7.3, 7.5, and 7.8. $VLP_{OPY-1}$ yield increased at pH 7.3, 7.5, and 7.8, while the $VLP_{OPY-1}$ K234N mutant yield did not increase at high pH (FIG. 8C).

That alphaviruses conserve lysine (K) at position 234 (Voss et al., *Nature* 468:709-712 (2010)), indicates that 234K plays important roles for the virus life cycle. Based on recent structure determination of CHIKV OPY-1 E2 protein, E2 234K is in an acid sensitive region (ASR) that was disordered in the alphavirus E2-E1 structure at low pH (Voss et al., Nature 468:709-712; Li L, 2010 nature p 705). This region initiates a conformational change in E1/E2 virus spikes in acidic pH conditions. The conformational changes allow the hydrophobic fusion peptide loop of E1 to interact with the cellular membrane and initiate fusion. The exposure of different pH conditions to Semliki Forest virus (SFV) particle changed the conformation of E1/E2 (Wu. SR, 2007, J of Biological chemistry, p 6752). The pH condition is also important for the budding process. The budding of SFV became efficient when the infected cells were incubated at a pH above 7.5 than at a pH below 7.0 (J of Virology. 2001, p 8329-8339, Lu et al.).

Figure 57:
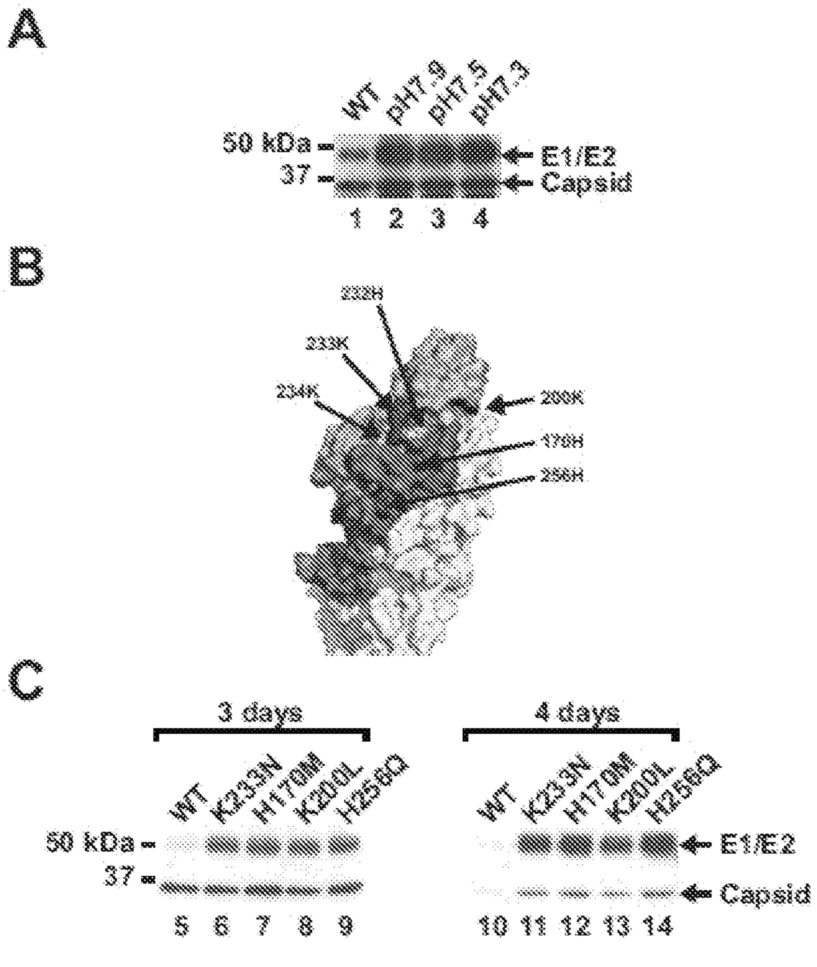
FIGS. 57A-57C show that VLP yield was significantly increased in high pH conditions.

Therefore, it was examined whether pH conditions in the medium increase the yield of $VLP_{OPY-1}$. The VLP yield was significantly increased in higher pH conditions (FIG. 57A). GFP expression as an expression indicator was similar level in different pH condition, suggesting that there was no protein expression effect in pH condition. Without being bound to a particular theory, it was hypothesized that K234N mutant might decrease the activity of the pH sensor amino acids and result in the increase of VLP yield. Histidine amino acids in E1/E2 play important roles for the pH dependent conformational change, as the pK is in the same range as the pH of the conformational transition (Voss et al., Nature 468:709-712). Without being bound to a particular theory, it was hypothesized that 232H might play an important role as a pH sensor because 234K and 232H are in close proximity with one another based on the structure model (FIG. 57B). To test this hypothesis, it was examined whether additional alternation of this specific region of E2 also affected VLP production (FIG. 57C). Although several point mutations in 232H were introduced to be insensitive to pH, none of the mutants produced the VLPs, possibly due to destabilization by the mutations. It was found that K233N or H256Q in ASR region mutants increased the yield of VLPs (FIG. 57C, lane 6, 9, 11 and 14). Because K233N mutant is next to 232H, it might have the same effect as the K234N mutant. In addition, mutation E2 H170M was also introduced into the OPY-1 strain, as these amino acids interact strongly with a salt bridge and one hydrogen bond between E2 and E1 (Voss et al., Nature 468:709-712). The mutant E2 H170M increased the yield of OPY-1 VLPs (FIG. 57C, lane 7 and 12). These mutants suggesting that inactivation of amino acids that play important roles in E1/E2 conformational change increased VLP synthesis.

Thus, specific sequences in the E2 region responsible for robust CHIKV VLP generation were identified, and this mechanism was related to pH dependent E1/E2 conformational change. It has been shown that alphavirus assembly and budding efficiency is related to several factors, such as pH condition (J of Virology. 2001, p 8329-8339, Lu et al), the COOH-terminal of E1 and E2 palmitylation (Ivanova et al., J. Virol. 67:2546-2551; Ryan et al., Virology 249:62-67), interactions between E1 and E2 (Yao et al., J. Virol. 72:1418-1423; Yao et al., J. Virol. 70:7910-7920), interactions between the cytoplasmic domain of E2 and capsid proteins (Kong et al., J Virol 77:12764-12772; Wilkinson et al., Biochemistry 44:2800-2810; Zhao et al., EMBO J. 13:4204-4211) or the requirement for cholesterol in the cell membrane (Lu et al., J. Virol. 73:4272-4278; Marquardt et al., J. Cell. Biol. 123:57-65; Vashishtha et al. J. Cell. Biol. 140:91-99); however, no studies have shown a correlation of budding efficiency with the E2 ASR. This observation suggests that correct conformation of the E1/E2 is important for budding efficiency and several amino acids in ASR play an important role for E1/E2 conformational change for budding and entry. Although further studies are needed to develop the vaccine against alphaviruses, since VLP vaccines are known to have advantages, such as a good safety profile and their ability to induce high levels of immunogenicity (Bachmann et al., Science 262:1448-1451; Chackerian, Vaccines 6:381-390). (Akahata 2010), VLP vaccine strategy may prove to be optimal and this results described here furthers developments of alphavirus vaccines.

Example 7

Importance of Amino Acid 234 in the E2 Protein of Other Alphaviruses in VLP Production To determine the role of the amino acid corresponding to amino acid 234 of CHIKV in other alphaviruses, the sequences of the E2 protein for Aura virus, Una virus, Mayaro virus, Middelburg virus, O'nyong-nyong virus (strain SG650), Ndumu virus, Barmah Forest virus, Seal louse virus, Salmon pancreas disease virus (SPDV), Whataroa virus, Sindbis virus, Western equine encephalomyelitis virus (WEEV), Venezuelan equine encephalitis virus (VEEV), Ross river virus (strain NB5092), Bebaru virus, Semliki forest virus, Alphavirus M1, Fort Morgan virus, and Eastern equine encephalitis virus (EEEV) were aligned using the NCBI database. Examination of these sequences revealed that the K at the position corresponding to amino acid 234 of CHIKV was highly conserved. Similarly, the generation of VLP from expression vectors encoding the structural genes of these viruses is typically low. A representative sequence alignment showing the sequences of the E2 protein from CHIKV 37997, CHIKV OPY-1, Ross River, Sindbis, WEEV, EEEV, and WEEV is shown in FIG. 9A.

Figure 9B:
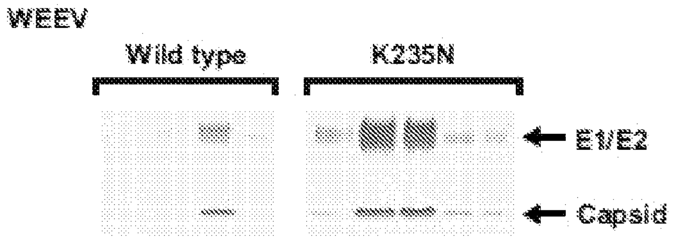
Figure 9C:
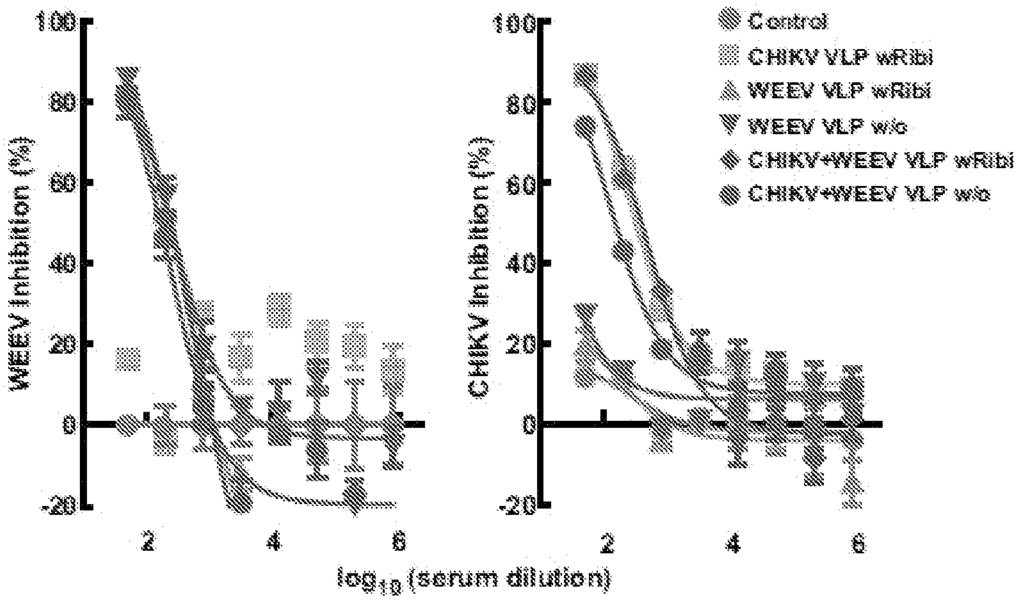
Figure 10A:
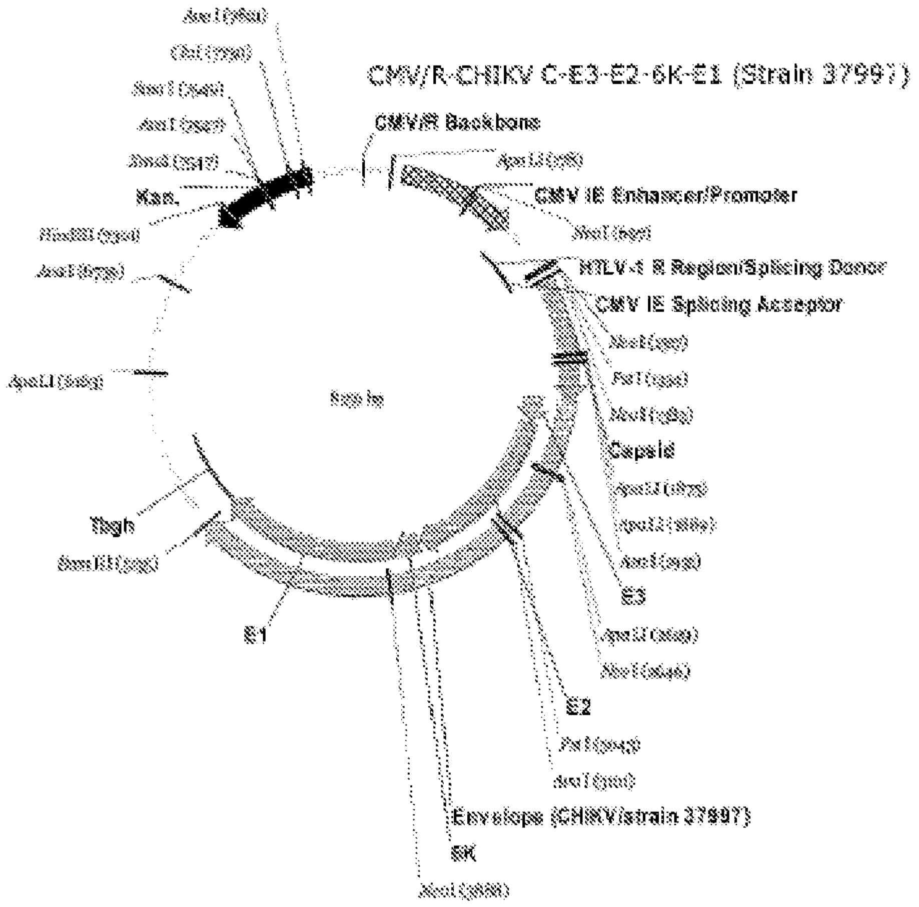
FIG. 10A shows the CMV/R-CHIKV C-E3-E2-6K-E1 plasmid (Strain 37997).
Figure 11:
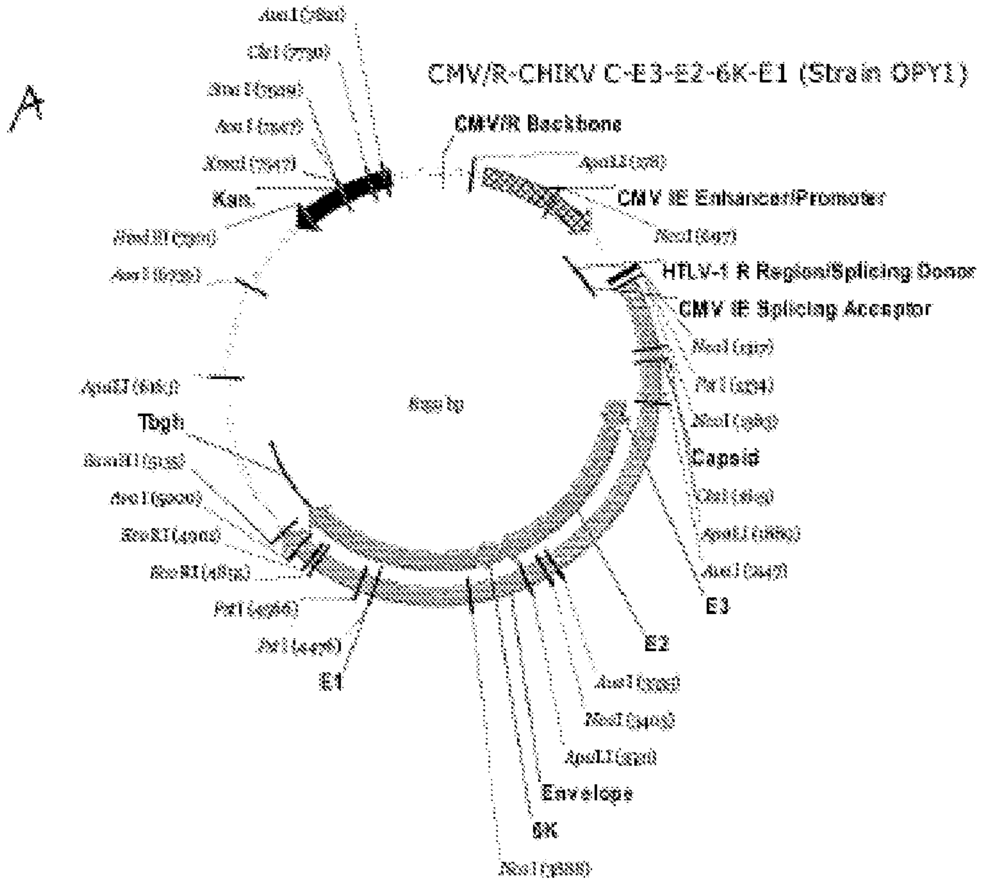
FIG. 11A shows the CMV/R-CHIKV C-E3-E2-6K-E1 plasmid (Strain OPY1).
FIG. 11B shows the sequence of the insert (SEQ ID NO:76).
FIG. 11C shows the entire plasmid sequence (SEQ ID NO:77).
Figure 26A:
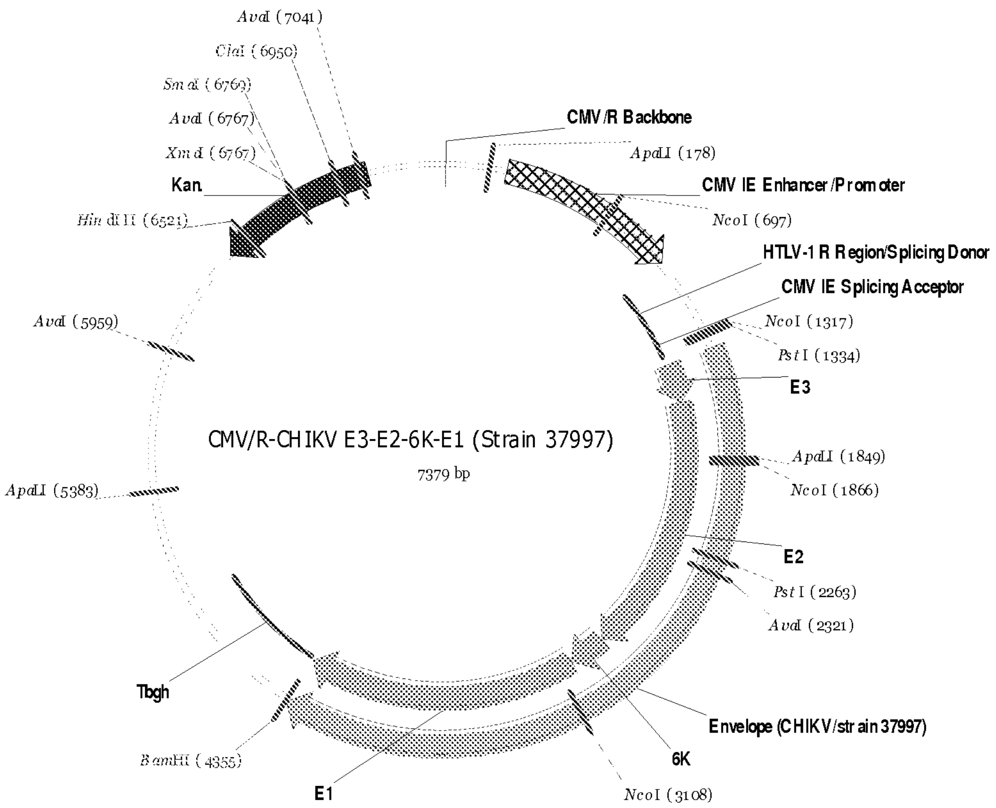
FIG. 26A shows the CMV/R-CHIKV E3-E2-6K-E1 plasmid (Strain 37997).

To evaluate the effect of this residue in WEEV, an expression vector encoding WEEV E2 with the K235N mutation was prepared. Mutation of K235N in the WEEV expression vector increased VLP yield by >7-fold in transfected 293F cells compared to the wild type WEEV expression vector (FIG. 9B). These VLPs were immunogenic in mice. Neutralizing antibody responses in BALB/c mice were measured using a pseudotyped lentiviral vector system (see Akahata et al., *Nat. Med.* 16:334-338 (2010)) after immunization with WEEV VLPs, alone, or in an equal mixture with CHIKV VLPs. Mice immunized with WEEV or WEEV and CHIKV VLPs generated similarly high titers of neutralizing antibodies to WEEV (FIG. 9C). This result indicated that the WEEV VLPs were effective immunogens and that combination with CHIKV did not diminish their immunogenicity. To determine whether these immune responses are protective, immunized mice can be challenged with a lethal dose of a heterologous WEEV, the Fleming strain, a highly virulent strain isolated from a human patient. If the immune responses are protective, mice immunized with WEEV VLPs will be able to control the challenge virus.

Example 8

Alterations in Alphavirus Capsid Protein NLS Increase VLP Yield

The ability to produce large quantities of VLPs is important to their use as vaccines. The yield of VLPs from CHIKV strain 37997 was 100 times greater than that of the OPY-1 strain, although the amino acid profiles of the two strains are more than 95% identical. Other alphaviruses showed varying but lower yields of VLPs or no VLP expression. Based on these observations, an analysis of the structure of CHIKV and other alphaviruses was undertaken to determine which regions are responsible for this difference in VLP yields.

Figure 35:
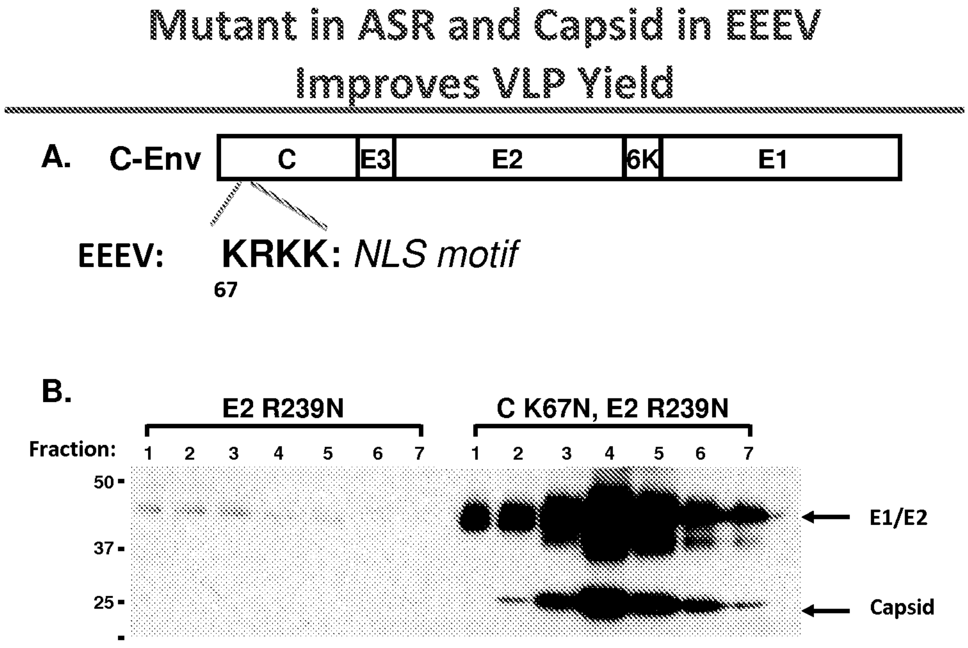
FIGS. 35A and 35B show that alterations in an EEEV capsid protein NLS and an E2 envelope protein generate expression of VLPs and increase VLP yield when expressed in mammalian cells.

Different mutations were made to the EEEV capsid protein and subsequently tested to determine their effect on cellular toxicity, as well as their ability to improve VLP yields when expressed in mammalian cells. Several mutants were made to the acid sensitive region (ASR) region of EEEV capsid protein, but this did this not improve EEEV VLP expression. Interestingly, there was no capsid expression in the supernatant. For example, in EEEV VLP constructs expressing the EEEV E2 envelope variant R239N EEEV capsid protein was undetectable by Western Blot in fractions collected from density gradient centrifugation (FIG. 35B). Additionally, EEEV capsid protein was observed in the nucleus at early time points after EEEV infection, although it was exported into the cytoplasm in the late stage of replication. Eastern Equine Encephalitis Virus (EEEV) capsid has also been reported as toxic to cells (Aguilar et al. 2007, Journal of Virology 81(8):3866-76 at page 3866).

The Eastern Equine Encephalitis (EEEV) capsid protein has a predicted nuclear localization signal (NLS) at amino acid (a.a.) positions 67-70 (FIG. 35A). Targeted mutations to the nuclear localization signal (NLS) motif (KRKK) (SEQ ID NO:2) of EEEV capsid protein were created that changed lysine (K) to asparagine (N) at amino acids 67 (K67N), 68 (K68N) and 69 (K69N). The lysine (K) to asparagine (N) mutation was designed to diminish the inhibition of VLP production by the NLS. The structure and properties of the proposed modifications to the nuclear localization signal (NLS) were analyzed using PredictProtein software. Maps and sequences of exemplary EEEV PE-6 strain capsid protein K67N expression vectors are shown at FIGS. 47A-47D and 48A-48D.

Modification of the EEEV capsid protein NLS resulted in improved yields of EEEV VLPs when expressed in mammalian cells. The K67N mutation was tested alone, in combination with K68N, or in combination with K68N and K69N. All 3 groups of EEEV capsid protein mutations showed a substantially increased level of VLP expression when compared to the wild type version of the EEEV capsid protein. For example, in EEEV VLP constructs expressing an EEEV E2 envelope variant R239N and an EEEV variant capsid protein K67N, abundant EEEV VLPs having were readily detectable by Western blot of density gradient centrifugation fractions (FIG. 35B). In contrast, in EEEV VLP constructs expressing an EEEV E2 envelope variant R239N and wild-type EEEV capsid protein, EEEV VLPs and EEEV capsid proteins were undetectable by Western Blot in corresponding density gradient centrifugation fractions (FIG. 35B). Thus, an alteration in a EEEV capsid protein NLS provided EEEV VLP expression and increased EEEV VLP yield.

Figure 36:
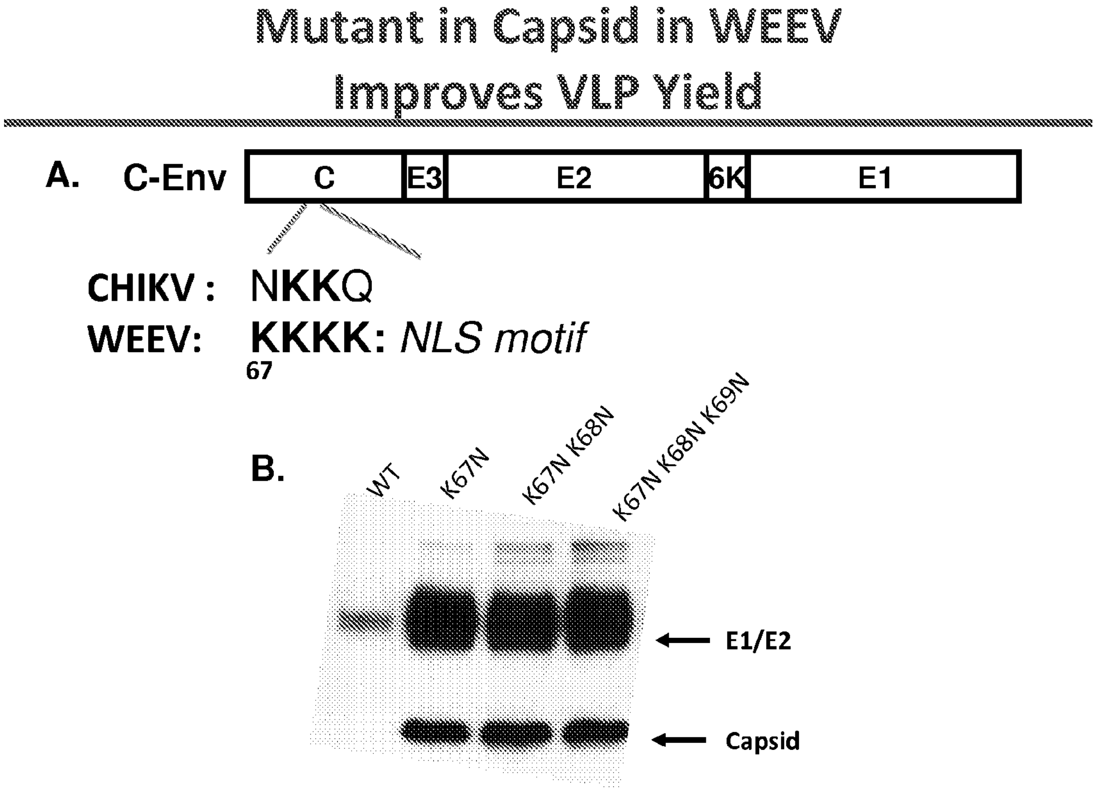
FIGS. 36A and 36B show that an alteration in a WEEV capsid protein NLS generates expression of VLPs and increases VLP yield when expressed in mammalian cells.
Figure 37:
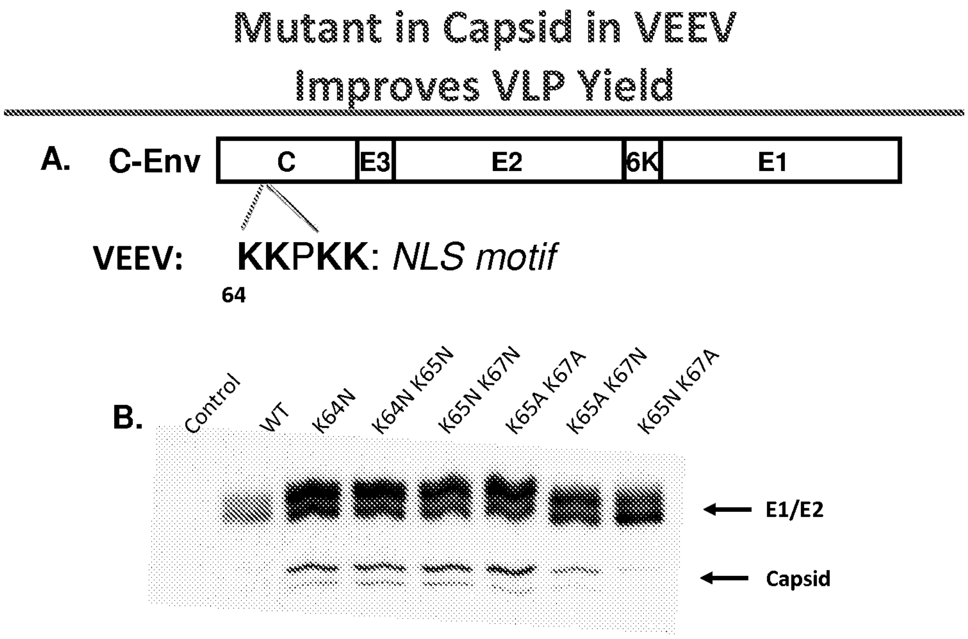
FIGS. 37A and 37B show that an alteration in a VEEV capsid protein NLS increases VLP yield when expressed in mammalian cells.

Alphavirus capsid proteins have amino acid sequences that can act as nuclear localization signals. Additional alphavirus capsid protein NLS sequences were identified as above. The Western Equine Encephalitis Virus (WEEV) capsid protein has a predicted nuclear localization signal (NLS) at amino acid (a.a.) positions 67-70 (FIG. 36A). The Venezuelan Equine Encephalitis Virus (VEEV) capsid protein has a predicted NLS at amino acid positions 64-68 (FIG. 37A). The Chikungunya (CHIKV) capsid protein has a predicted nuclear localization signal (NLS) at amino acid (a.a.) positions 62-69. The Ross River virus capsid protein has a predicted nuclear localization signal (NLS) at amino acid (a.a.) positions 71-74. The Barmah Forest virus capsid protein has a predicted nuclear localization signal (NLS) at amino acid (a.a.) positions 64-68.

Figure 39:
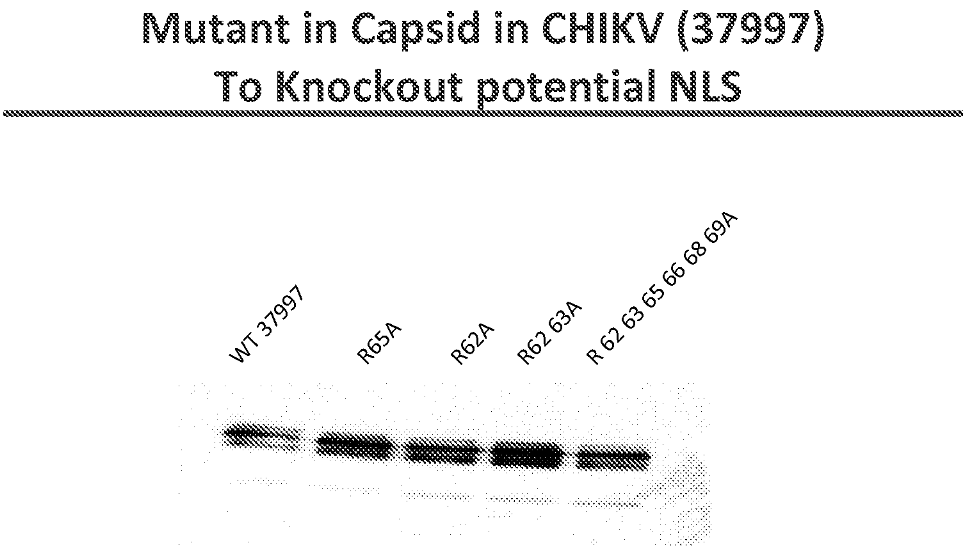
FIG. 39 depicts a Western blot of alterations in CHIKV (37997) capsid protein NLS to knock out the nuclear localization sequence.

Mutations to the alphavirus capsid protein have also been applied to Western equine encephalitis virus (WEEV) (FIG. 36B) and Venezuelan Equine Encephalitis Virus (VEEV) (FIG. 37B), which are similar to EEEV in sequence, and, like EEEV, are termed "new world" alphaviruses. Mutations to the alphavirus capsid protein have also been applied to Chikungunya (CHIKV) (FIG. 39) and Ross River viruses, which are termed "old world" alphaviruses. Maps and sequences of exemplary WEEV CBA87 strain capsid protein expression vectors having one or more of the alterations K67N, K68N, and/or K69N are shown at FIGS. 40A-40D, 41A-41D, and 42A-42D. Maps and sequences of exemplary VEEV TC83 strain capsid protein expression vectors having one or more of the alterations K64N, K65A, K65N, K67A, and/or K67N are shown at FIGS. 43A-43D, 44A-44D, 45A-45D, and 46A-46D. Maps and sequences of exemplary CHIKV(Strain 37997) strain capsid protein expression vectors having one or more of the alterations R62A, R63A, R65A, K66A, K68A, and/or K69A are shown at FIGS. 50A-50D, 51A-51D, and 52A-52D. Maps and sequences of exemplary Ross River Virus capsid protein expression vectors having one or more of the alterations R71N, K72N, K73N, and/or K74N are shown at FIGS. 53A-53D, 54A-54D, 55A-55D, and 56A-56D. Maps and sequences of exemplary Barmah Forest Virus capsid protein expression vectors having an alteration at K64A is shown at FIGS. 59A-59E.

Figure 38:
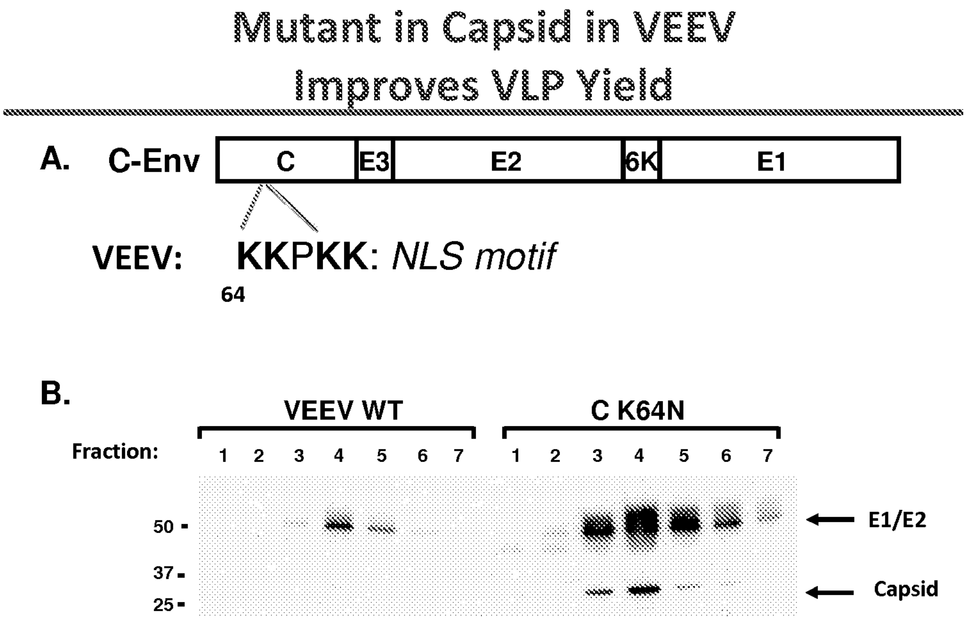
FIGS. 38A and 38B show that an alteration in a VEEV capsid protein NLS increases VLP yield when expressed in mammalian cells.

As with EEEV VLPs, WEEV VLPs having a wild-type capsid protein were unable to be expressed. The introduction of alterations to the WEEV capsid protein NLS provided WEEV VLP expression and increased WEEV VLP yield (FIG. 36B). The introduction of alterations to the VEEV capsid protein NLS increased VEEV VLP expression by more than 100-fold compared to the wild type VEEV and increased EEEV VLP yield (FIGS. 37B and 38B).

It has been discovered that mutating an NLS in an alphavirus capsid protein improves or allows expression of alphavirus VLPs in mammalian cells. Without being bound to a particular theory, the nuclear localization signal motif of the alphavirus capsid protein accumulates alphavirus capsid protein into the nucleus and prevents the secretion of alphavirus VLPs. Improvement in yields of alphavirus VLPs allows for their use as immunogenic compositions or vaccines, including a pan-alphavirus vaccine.

Example 9

High pH Mediates Efficient Virus-Like Particle Formation

As shown for CHIKV, it was examined whether pH conditions in the medium increase the yield of other VLPs. The VLP yield of EEEV was significantly increased under higher pH conditions, e.g., at pH 7.9 compared to at pH 7.1

Figure 60:
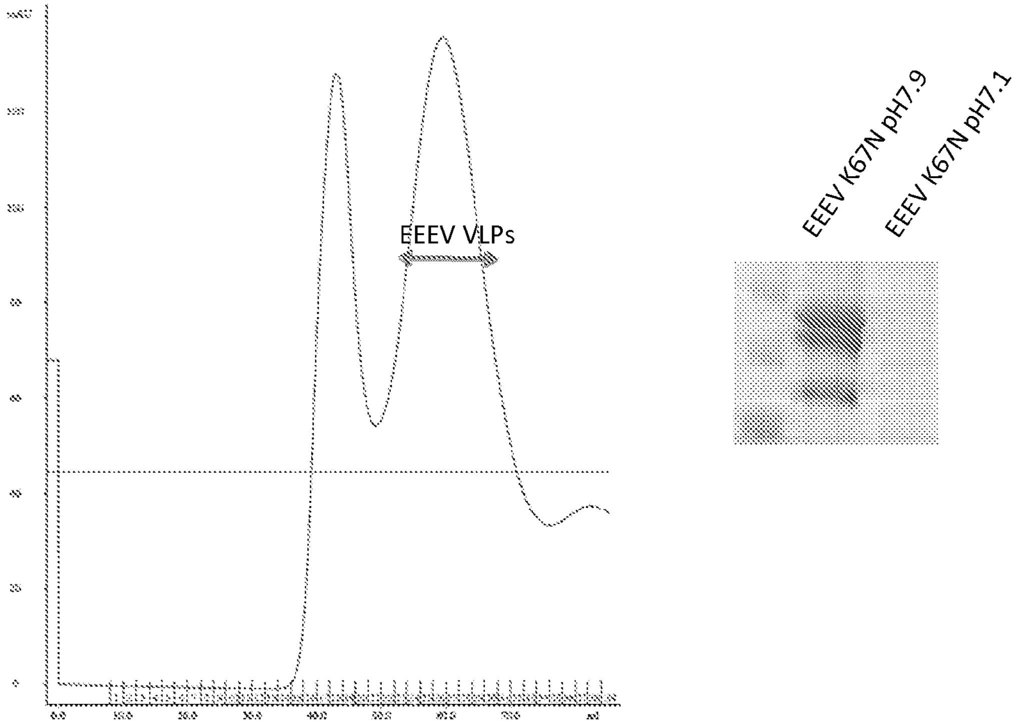
FIG. 60 shows that EEEV VLPs purified at pH 7.9 have higher yield compared to those purified at pH 7.1.
Figure 61:
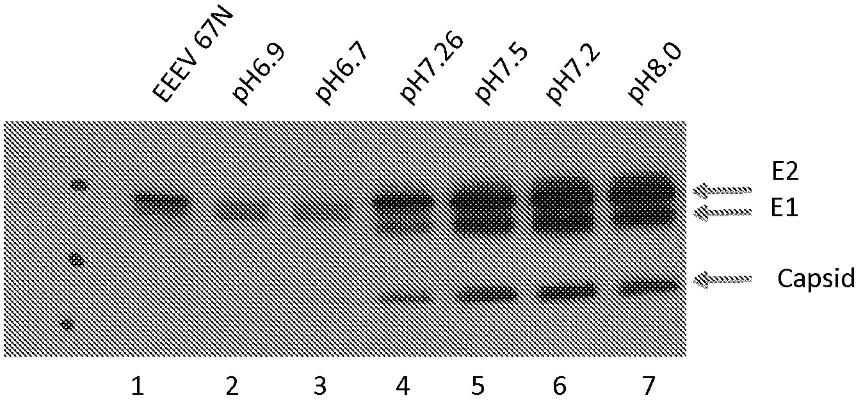
FIG. 61 is a Western Blot analysis showing that yield of EEEV VLPs is pH dependent.
Figure 62:
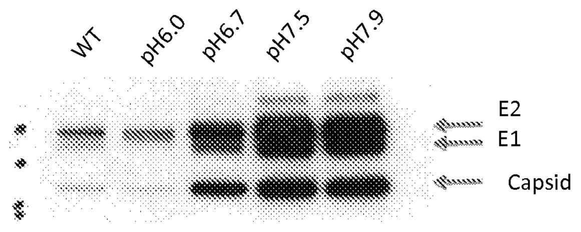
FIG. 62 is a Western Blot analysis showing that addition of Tris-HCl buffer 24 hr after transfection increased EEEV 67N VLP yield.

(FIG. 60). The yield of EEV VLP was shown to increase with increasing pH (FIG. 61). Additionally, the pH dependent effect on yield was also observed when Tris-HCl buffer was added to cells after transfection with expression vectors for EEEV67N VLP (FIG. 62) or $VLP_{OPY-1}$ (FIGS. 63A and B).

Figure 64:
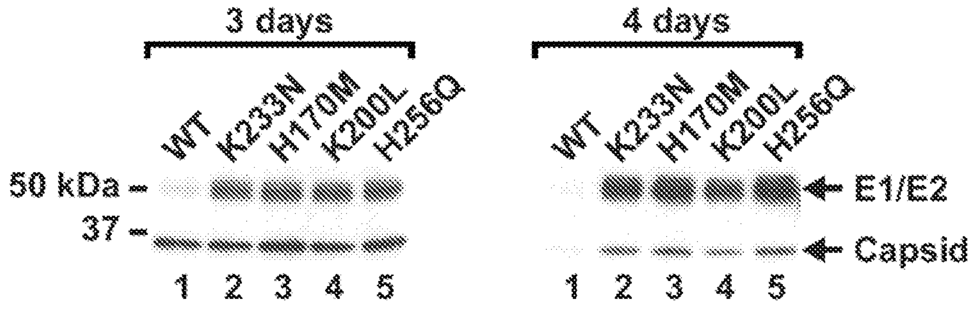
FIG. 64 is a Western Blot analysis showing that mutations to the pH sensitive ASR region of CHIKV OPY-1 increase stability of VLPs over 3-4 days, compared to wild-type VLPs.

Additional mutations in the pH sensitive region of CHIKV OPY-1 (K233N, H170M, K200L, and H256Q) were constructed and studied. The mutations in the pH sensitive region resulted in VLPs being stable longer than 3-4 days after transfection compared to wild-type VLP which was present at a lower level at 3 days and nearly undetectable at 4 days (FIG. 64).

Example 10

Figure 65:
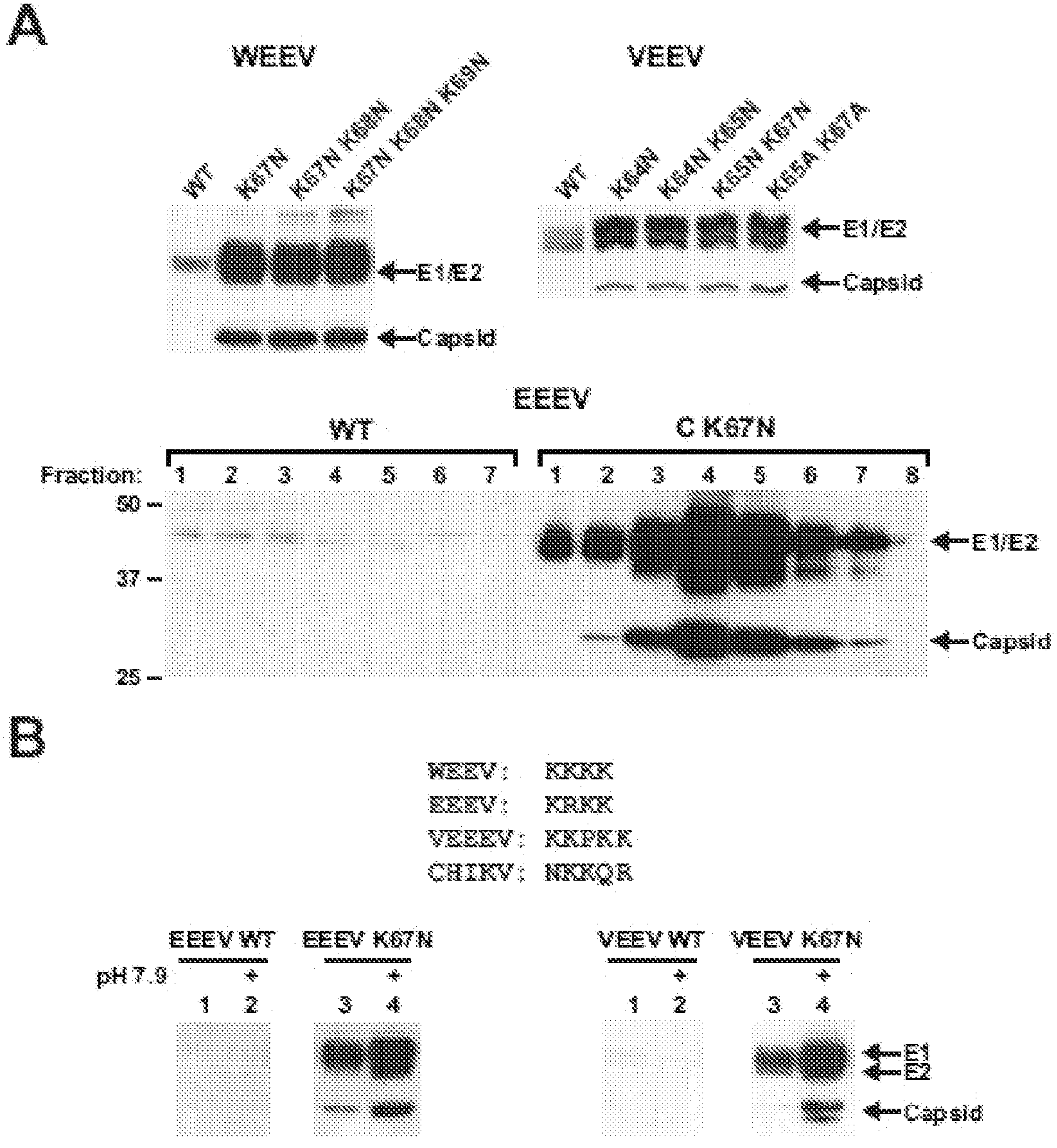
FIGS. 65A and 65B are Western Blots showing the expression and purification of WEEV, EEEV, and VEEV VLPs containing NLS signal mutations.

Multivalent Virus-Like Particle Vaccine Against Eastern, Western and Venezuelan Equine Encephalitis Virus Protected Mice Against Infection A multivalent virus-like particle (VLP) vaccine was developed against WEEV, EEEV and VEEV using VLPs that have the mutations that allowed WEEV, EEEV and VEEV to express VLPs. To evaluate the effect of the NLS signals, expression vectors were constructed encoding WEEV, EEEV and VEEV containing NLS signal mutations (FIGS. 65A and 65B). These mutations increased VLP yield by >100-fold compared to the wild type expression vector. The resulting VLPs were purified by buoyant density gradient sedimentation. Fractionation of clarified supernatant showed that the greatest incorporation of E1/E2 into the VLPs occurred at a density of 1.2 g/ml, and was comparable to the density of the wild type VLPs. Cryoelectron microscopy and three dimensional image reconstruction, assuming icosahedral symmetry, showed that the VLPs had an external diameter of 65 nm and a core diameter of 40 nm with T=4 quasi symmetry. These specifications were very similar to the structure of CHIKV VLPs and other WT alphaviruses previously described.

To evaluate the immunogenicity of these VLPs, BALB/c mice were injected intramuscularly with VLPs from an individual alphavirus VLPs or all the combinations of WEEV, EEEV and VEEV VLPs. While the immunized mice did not generate cross neutralizing antibodies to different viruses, they all produced high titer neutralizing responses against the virus with which they were immunized (FIG. 2A; $IC_{50}$, 1:36586, 1:17284, 1:2263 against VEEV, EEEV and WEEV, respectively). The mice vaccinated with multivalent VLPs showed high levels of neutralizing antibodies against all of the viruses (FIG. 66A: $IC_{50}$, 1:23492, 1:10796, 1:1091, against VEEV, EEEV, WEEV, respectively). This result indicated that the multivalent VLP vaccine was effective in eliciting a multivalent immune response and that combination with other alphavirus VLPs did not diminish immunogenicity against the individual viruses.

Figure 66:
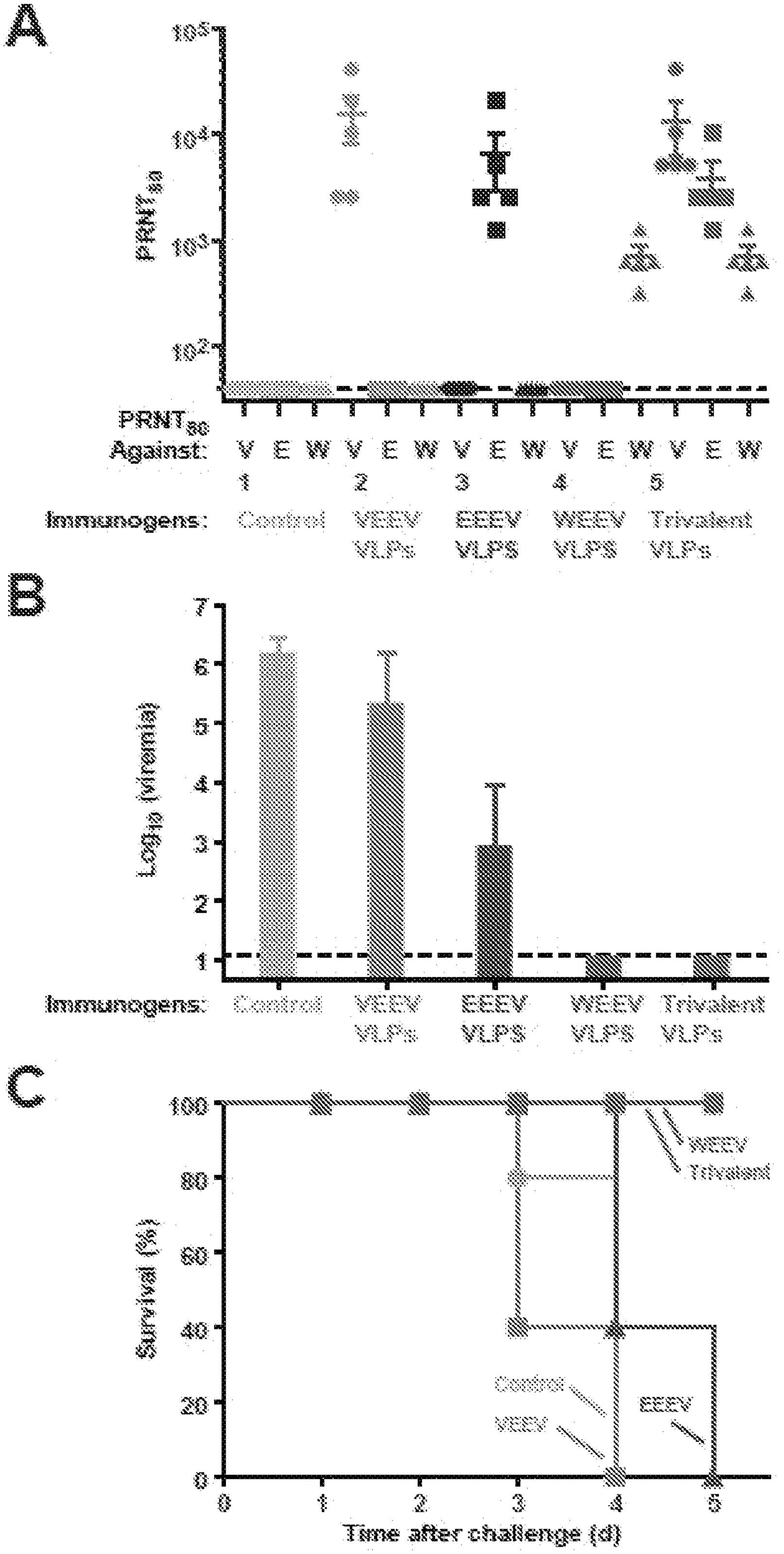
FIGS. 66A-66C are graphs showing that multivalent Virus-Like Particle vaccine against Eastern, Western and Venezuelan Equine Encephalitis Virus protected mice against infection.

To determine whether these immune responses were protective, immunized mice were challenged with a lethal dose of a heterologous WEEV, the Fleming strain, which is a highly virulent strain isolated from a human patient. High viremia was observed in the control, VEEV VLP and EEEV VLP groups but not in the WEEV VLPs and the trivalent groups (FIG. 66B). Mice immunized with WEEV VLPs controlled the challenge virus, while all control mice developed severe infections and died (FIG. 66C). These data demonstrate that the WEEV VLP vaccine, alone or in combination with VLP of another alphavirus, confers protection.

To characterize VLP-induced immune responses in a model with stronger predictive value for humans, rhesus macaques were immunized with VLPs. Monkeys were injected intramuscularly with WEEV VLPs alone, a multivalent WEEV/EEEV/VEEV VLP vaccine or PBS alone as a control. Sera from immunized and control monkeys are tested using pseudotyped lentiviral vectors and monkeys are challenged to measure protection from disease.

Although there have been several reports of progress in development of alphavirus vaccines, including a DNA vaccine (Nagata, L. P, 2005. Vaccine 23:2280-2283, Dupuy L, 2009, vaccine), a recombinant Ad5 vaccine (Barabe, N. D. 2007. Vaccine 25:6271-6276, Phillpotts 2005, vaccine 1615-1623), a live attenuated vaccine (Pittman P R, 1996; 14(4) p 337-43), and an inactivated vaccine (Coke F, Applied Microbiology, 1974, p 150-, Edelman R, Journal of infectious disease, 1979, Vol 140 p 708-), no candidates have been licensed to date. A live attenuated VEEV vaccine, TC-83, caused fever, headache and malaise in 25% and no response in 20% of vaccinated people (Pittman P R, 1996; 14(4) p 337-43). In addition, sequential administration of live attenuated alphavirus vaccines in human trials revealed an immunologic interference between the viruses and induced poor immunogenicity (McClain, D. J, 1998, J Infect Dis 177:634-641). A formalin-killed VEEV, EEEV and WEEV required multiple injections and even then, resulted in low levels of immunogenicity (Jahrling 1984, 19(3) p 429-31). Global climate, trade, and frequent travel has caused the spread of mosquitoes, the carrier of these viruses, to new geographic areas, which may pose a threat of other alphavirus outbreaks. In this study, an effective multivalent alphavirus VLP vaccine was developed, suggesting the potential for creating a more global pan-alphavirus VLP vaccine using this approach. The safety and efficiency of VLP vaccines combined with their relatively less complicated production requirements make them promising candidates in the future of vaccine field.

Example 9

Additional Embodiments

Additional embodiments are disclosed in the attached appendix, which is hereby incorporated by reference.

In this study, specific sequences in the E2 region were identified as responsible for robust CHIKV VLP generation. This strategy was then adapted to enhance the expression of a different alphavirus, WEEV. CHIKV is an enveloped positive-strand RNA virus, member of the alphavirus genus. Its structural proteins consist of one capsid (C) and an envelope (E) polyprotein that is processed to form E1/E2 heterodimers. The structural proteins are synthesized as polyproteins and are cleaved by capsid autoproteinase between the capsid and envelopes. The capsid protein assembles into a core particle, which is transported to the plasma membrane. After cleavage of the capsid protein, the PE2 (the precursor to the E3-E2 proteins)-6K-E1 envelope polyprotein is recognized by a signal sequence in the E3 protein domain to direct translocation into the endoplasmic reticulum (ER) membrane and transported to the cell surface through the Golgi network. PE2 is cleaved by furin, and E3 dissociates from E2. E1 and E2 then form a heterodimer (E1/E2). Capsid proteins associate with envelope on the cell surface and are encased within a lipid bilayer containing viral envelope proteins that initiate the budding of viral particles.

It has been shown that alphavirus assembly and budding efficiency is related to several factors, such as the COOH-terminal of E1 and E2 palmitylation, interactions between E1 and E2, interactions between the cytoplasmic domain of E2 and capsid proteins or the requirement for cholesterol in the cell membrane; however, no studies have shown a correlation of budding efficiency with the E2 and E3 binding domains. Interestingly, several mutants that block the furin cleavage site between E2 and E3 have been characterized, and most of these rescue mutants contain modifications in residues associated with the E2 and E3 binding domain. This observation suggests that destabilization of the E3/E2 binding domain is important for restoring infectivity, and that conformational changes due to the destabilization might help increase virus replication, including the maturation and fusion processes.

WEEV transmitted by mosquitoes has caused encephalitis in birds, horses and humans in the USA, Canada and South America. Because of these reports of illness and the potential bioterrorism threat through aerosol transmission, WEEV vaccine development is important. Although there have been several reports of progress in WEEV vaccine development, including a DNA vaccine and a recombinant Ad5 vaccine, no candidates have been licensed to date. Since VLP vaccines are known to have advantages, such as a good safety profile and their ability to induce high levels of immunogenicity, this vaccine strategy may prove to be optimal.

Previous human trials revealed immunologic interference from sequential administration of live attenuated vaccines against heterologous alphaviruses using CHIKV and Venezuelan equine encephalitis virus. In this study, the combination of CHIKV and WEEV VLPs in a vaccine did not decrease the immune responses against both viruses, suggesting that a pan-alphavirus VLP vaccine that could include other pathogenic alphaviruses, such as Eastern equine encephalitis virus, Venezuelan equine encephalitis virus Ross River virus, or Barmah Forest virus might be possible. The results described here furthers our understanding of the mechanism of VLP budding and vaccine development in alphaviruses.

VLPs are known to be highly immunogenic and elicit higher titer neutralizing antibody responses than subunit vaccines based on individual proteins. Such VLPs authentically present viral spikes and other surface components in a repetitive array that effectively elicits recognition by B-cells to stimulate antibody secretion. This recognition leads to B cell signaling and MHC class II up-regulation that facilitates the generation of high titer specific antibodies. VLPs from other viruses, including hepatitis B virus (HBV) and human papillomavirus (HPV), elicit high titer neutralizing antibody responses that contribute to protective immunity in humans. Similarly, alphavirus VLPs have been found to confer protection against alphavirus infection in a non-human primate model of infection.

Accordingly, VLPs are a viable vaccine strategy for treating alphavirus and flavivirus infection. As reported herein, alphavirus VLPs can be modified at the amino acid positions corresponding to amino acids 234 and 251 in the CHIKV E2 protein to enhance the production of VLPs. The methods described herein provide an attractive approach to developing and producing vaccines for alphaviruses and flaviviruses.

The results reported herein were obtained using the following methods and materials.

Vector Construction

Plasmids encoding the structural polyproteins C, E1, E2, E3 and 6K (strains 37997 and LR2006 OPY-1, GenBank EU224270) (FIG. 24) and EU224268 (FIG. 23), respectively) were synthesized as previously described (Yang et al., *Science* 317, 825 (2007)) (GeneArt, Regensburg, Germany). Plasmids encoding the polyproteins E3, E2, 6K, and E1 were amplified by PCR using the following primers:

```
sense primer
                                    (SEQ ID NO: 58)
5' GCTCTAGACACCATGAGCCTCGCCCTCCCGGTCTTG 3'
and

antisense primer
                                    (SEQ ID NO: 59)
5' TGGATCCTCATTAGTGCCTGCTAAACGACA 3'
(37997);
and

sense primer
                                    (SEQ ID NO: 60)
5' GCTCTAGACACCATGAGTCTTGCCATCCCAGTTATG 3'
and

antisense primer
                                    (SEQ ID NO: 61)
5' TGGATCCTCATTAGTGCCTGCTGAACGACA 3'
(LR2006 OPY-1).
```

XbaI and BamHI sites were inserted for cloning. Each fragment was digested with XbaI/BamHI and inserted into a eukaryotic expression vector under the control of a cytomegalovirus enhancer/promoter, CMV/R (Yang et al., *Science* 317, 825 (2007)) ($C\text{-}E_{37997}$, $C\text{-}E_{OPY\text{-}1}$, $E_{37997}$ *and* $E_{OPY\text{-}1}$). To confirm expression of CHIKV C and E proteins, 293T cells were transfected using a FuGENE™ 6 Transfection Reagent kit (Roche Diagnostics GmbH, Germany) with 3 μg of the plasmid DNAs, following the manufacturer's recommendations.

The chimeric CHIKV and WEEV expression vectors $VLP_{C(37997)}$, $VLP_{C\text{-}E3(37997)}$, $VLP_{C\text{-}E2(37997)}$, $VLP_{C\text{-}6K(37997)}$, $VLP_{OPY\text{-}1\ E2(37997)}$, $VLP_{OPY\text{-}1\ 5'\text{-}E2(37997)}$, and $VLP_{OPY\text{-}1\ 3'\text{-}E2(37997)}$ were constructed using an overlap extension PCR method described previously in Kong et. al., *J. Virol.* 77, 12764 (2003). The chimeric genes between 37997 and OPY-1 strains were amplified using the primers shown in Table 1 (see above). Briefly, two fragments of the chimeric genes were amplified with 40 to 51 base pairs of primers that overlapped by 20 oligonucleotides and either of CHIKV 37997 F, CHIKV 37997 R, CHIKV OPY-1 F or CHIKV OPY-1 R primers. These two fragments were assembled in the overlapping region and amplified again with CHIKV 37997 F, CHIKV 37997 R, CHIKV OPY-1 F or CHIKV OPY-1 R primers. The PCR products were cloned into the $VLP_{OPY\text{-}1}$ expression vector after confirming of sequence. A vector encoding the Western Equine Encephalitis virus (WEEV) structural polyproteins C-E3-E2-6K-E1 (strain 71V-1658, GenBank AF214040) was synthesized as previously described in Akahata et. al., *Nat. Med.* 16, 334 (2010). CHIKV and WEEV mutants were made using the PCR-based Quickchange (Stratagene, La Jolla, Calif.) method according to the manufacturer's instructions with sense and anti-sense primers shown in Table 1 (see above). Each mutant was confirmed by sequencing. Other sequences and maps useful to the invention include those shown at FIGS. 10A-10C, 11A-11C, 12A, 12B, 13A, 13B, 14A, 14B, 15A, 15B, 16A, 16B, 17A, 17B, 18A, 18B, 19A, 19B, 20A, 20B, 21A, 21B, 22A, 22B, 23A, 23B, 24A, 24B, 25A, 25B, 26A, 26B, 27, 28, 29A, 29B, 30A-30C, 32A-32C, 33A-33C, 34A and 34B, 38A, 58A-58E, and 59A-59E.

Cell Culture 293T and 293A (human embryonic kidney cells), Vero (African green monkey kidney epithelial cells), HeLa (human cervical adenocarcinoma), A549 (human lung carcinoma) and BHK (baby hamster kidney cells) were cultured in Dulbecco's modified Eagle's medium (DMEM; GIBCO BRL, Carlsbad, Calif.) containing 10% heat-inactivated fetal bovine serum (FBS) (GIBCO BRL, Carlsbad, Calif.).

Production of Pseudotyped Lentiviral Vectors

Lentiviral vectors expressing glycoproteins from different CHIKV strains were created. The recombinant lentiviral vectors expressing a luciferase reporter gene were produced as previously described (Naldini et al., *Proc. Natl. Acad. Sci. USA* 93, 11382 (1996), Yang et al., *Science* 317, 825 (2007)). Briefly, 293T cells were co-transfected with 500 ng CHIKV E plasmid from either strain $_{(E37997}$ $^{or}$ $E_{OPY-1)}$, 7 μg of a transducing vector encoding a luciferase reporter gene (pHR'CMV-luciferase plasmid), and 7 μg of a packaging plasmid expressing human immunodeficiency virus-1 (HIV-1) structural proteins (pCMVåR8.2). 2 μg of vesicular stomatitis virus glycoprotein (VSV-G), 2 μg of pNGVL-4070A amphotropic MuLV gp70 expression vector or 500 ng of empty vector served as positive and negative controls for these pseudotyped reporters respectively. After a calcium phosphate transfection (Invitrogen, Carlsbad, Calif.) overnight, the culture media was replenished with fresh media. 48 hours later, supernatants were harvested, filtered through a 0.45 μm syringe filter, stored in aliquots, and frozen at −80° C. The viruses were standardized by the amount of HIV-1 Gag p24. CHIKV pseudotyped lentiviral vectors harvested 72 hours after transfection were normalized according to HIV-1 Gag p24 levels before infection, as previously described (Yang et al., *Science* 317, 825 (2007)).

When the 293-derived suspension cell line 293F (Invitrogen, Carlsbad, Calif.) was used, the 293F cells were cultured in FreeStyle™ 293 Expression medium (Invitrogen, Carlsbad, Calif.). 293F cells ($3\times10^7$) (Invitrogen) were transfected with 293fectin transfection reagent (Invitrogen, Carlsbad, Calif.) and 30 μg of each VLP plasmid following the manufacturer's recommendations Buoyant Density Gradient Sedimentation Analysis and Purification of VLPs Buoyant density gradient analysis and purification of VLPs was performed as described previously in Akahata et al., *J. Virol.* 79, 626 (2005) and Akahata et. al., *Nat. Med.* 16, 334 (2010). Briefly, a 293-derived suspension cell line, 293F ($2.5\times10^8$ cells) (Invitrogen, Carlsbad, Calif.) was transfected with 293fectin transfection reagent (Invitrogen, Carlsbad, Calif.) and 125 μg of $C_{-E37997}$ plasmid following the manufacturer's recommendations. The supernatants were harvested 72 hours after transfection and filtered through a 0.45 ȝ m pore size filter, then layered onto a 60% Optiprep (Iodixanol) medium (Invitrogen, Carlsbad, Calif.) and centrifuged at 50,000×g for 1.5 hours with a Surespin 630 rotor (Sorvall). The supernatants were removed to leave 4 ml above the virus band and mixed to a 20% final concentration of OptiPrep. A density gradient was formed by centrifugation at 360,000×g for 3.5 hours with an NVT100 rotor (Beckman). 500 μl of each fraction was collected, weighed, and the densities of the fractions were plotted. 20 μl of each fraction was separated on a 4%-15% SDS-PAGE gel, and then stained using a Coomassie staining kit (InstantBlue, expedeon) following the manufacturer's recommendations or transferred onto an Immobilon-P membrane, and blotted with antisera reactive to the respective alphavirus (EEEV, WEEV, VEEV, CHIKV) as a primary antibody (e.g., sera from mice injected with the CHIKV strain S-27 (ATCC, VR-1241AF), CHIKV VLPs (strain 37997), or WEEV immune ascitic fluid (ATCC, VR-1251AF)) and goat anti-mouse immunoglobulins linked to horseradish peroxidase as a secondary antibody (Santa Cruz Biotechnology, Santa Cruz, Calif.).

Production and Purification of Anti-CHIKV Mouse Monoclonal Antibodies

Monoclonal antibodies against CHIKV E2 were developed based on methods described previously in Yang et al., *Science* 317, 825 (2007). Briefly, female BALB/c mice were immunized with CHIKV VLPs three times. Injections with 20 μg CHIKV VLPs were administered every 4 weeks for a total of 3 injections. Three days after the final boost, spleens from the mice were harvested and used to produce hybridoma cells. Hybrids producing the antibody of interest were screened by ELISA using plates coated with CHIKV VLPs, and also using a neutralizing assay employing CHIKV psuedotyped viral vectors as previously mentioned in Akahata et. al., *Nat. Med.* 16, 334 (2010). Two clones, m10-18 and m242, showed strong neutralization and were purified as described previously in Yang et al., *Science* 317, 825 (2007).

Neutralization of CHIKV E Pseudotyped Lentiviral Vectors by Mouse and Monkey Antisera The neutralization assay was performed as described previously (Yang et al., *Science* 317, 825 (2007)). A total of $10^4$ 293A cells were plated into each well of a 96-well dish one day prior to infection. CHIKV E-pseudotyped lentiviral vectors encoding luciferase were first titrated by serial dilution. Similar amounts of pseudotyped lentiviral vectors (with p24 levels of approximately 50 ng/ml) were then incubated with the indicated dilutions of mouse antisera for 60 minutes at room temperature prior to adding the virus: sera solution to 293A cells ($10^4$ cells/well in a 96-well dish, 50 μl/well, in triplicate). Sera from non-immune mice or monkeys were used as a negative control. After a 24 hour incubation, cells were lysed using cell lysis buffer (Cell Signal) and the luciferase activity was measured using Microbeta® JET (PerkinElmer, Turku, Finland) following incubation with "Luciferase assay reagent" (Promega, Madison, Wis.), according to the manufacturer's protocol Inhibition values were calculated as follows: inhibition (%)=[1−(luciferase activity (cps) in pseudotyped lentiviral vector infected cells incubated with the indicated dilutions of mouse antisera)/(luciferase activity (cps) in pseudotyped lentiviral vector infected cells incubated with the same dilutions of non-immune mouse serum)]×100. The $_{IC50}$ was calculated with Prism software (version 5).

Electron Microscopy

The morphology of the VLPs was examined by the Image Analysis Laboratory at the National Cancer Institute. VLPs were purified by Optiprep density centrifugation and were then fixed in 4% formaldehyde in PBS. Negative-stain electron microscopy for viral diagnosis has been described previously (Palmer and Martin, Electron Microscopy in Viral Diagnosis (CRC Press, Boca Raton, Fla., 1988)). Briefly, 1.0 μl of the sample was placed onto a carbon-coated Formvar-filmed copper grid (Tousimis Research Corp., Rockville, Md.) and VLPs were allowed to attach. The VLPs were negatively stained by addition of 2 μl of 1% PTA solution (phosphotungstic acid, pH 7.0) (Fisher Scientific Co., Fairlawn, N.J.). The grid was then examined by electron microscope (Hitachi H7000, Tokyo, Japan) operated at 75 kV. Digital images were taken by a CCD camera (AMT, Danvers, Mass.).

Cryo-Electron Microscopy and Image Analysis

CHIKV VLPs were flash-frozen on holey grids in liquid ethane. Images were recorded at 47K magnification with a CM300 FEG microscope with electron dose levels of approximately 20 $e^{i}/Å^2$. All micrographs were digitized at 6.35 μm pixel$^{i1}$ using a Nikon scanner. Individual particle images were boxed using the program e2boxer in the EMAN2 package (Tang et al., *J Struct. Biol.* 157, 38 (2007)). CTF parameters were determined and phases were flipped using the CTFIT program from the EMAN package (Ludtke et al., *J. Struct. Biol.* 128, 82 (1999)). An initial model was constructed in EMAN using assigned 2-, 3-, and 5-fold views and was refined in EMAN assuming icosahedral symmetry. The number of particles incorporated into the final reconstruction was 1489, giving a final resolution of 18 Å based on a 0.5 Fourier shell correlation threshold.

Immunizations and Challenge of Mouse and Monkeys

19 μg of VLPs (equivalent to approximately 10 μg of E1/E2) in 60 μl normal saline were mixed with 60 μl of Ribi solution (Sigma Adjuvant system, Sigma-Aldrich) per mouse following the manufacturer's recommendations. Female 6- to 8-week-old BALB/c mice were injected in the right and left quadriceps muscles with VLPs in normal saline or Ribi in 120 μl total volume, two times at weeks 2 and 6. For DNA vaccination groups, the mice were injected in the right and left quadriceps muscles with a total of 15 μg of purified plasmid C-$E_{37997}$, $E_{37997}$, C-$E_{OPY\text{-}1}$, or $E_{OPY\text{-}1}$ suspended in 100 μl of normal saline three times at weeks 0, 3, and 6. Five mice/group were injected. 10 days after the last injection, sera and spleen were collected.

In the monkey experiments, rhesus macaques (*Macaca mulatta*) weighing 3-4 kg were injected intramuscularly in the anterior quadriceps with either twenty μg of VLPs in 1 ml PBS (VLP group) or 1 ml PBS alone (control group) at weeks 0, 4 and 24. Six monkeys/group were injected. Blood was collected to measure antibody titers on days −14, 0, 10, 28, 38, 56, 70, 161 and 178. The monkeys (n=3 per group, randomly selected from each group) were challenged with $10^{10}$ PFU of CHIKV (strain LR2006 OPY-1) by intravenous injection. Blood was collected to measure viremia at 0, 6, 24, 48, 72, 96, 120 and 168 hours. The monkeys were sacrificed at 168 hours after challenge. The whole blood cells were measured using a hematology analyzer (IDEXX Laboratories, Inc., Westbrook, Me.). Bleeds were EDTA-anticoagulated using 20-22 gauge needles and either syringes or vacuum tubes. The maximum blood volume removed did not exceed 20% (12 ml/kg) per month, with no more than 15% (9 ml/kg) removed during any single draw.

All animal experiments were reviewed and approved by the Animal Care and Use Committee, Vaccine Research Center (VRC), National Institute of Allergy and Infectious Diseases and performed in accordance with all relevant federal and National Institutes of Health guidelines and regulations.

Virus Preparation

CHIKV (strain LR2006 OPY-1) was prepared and the virus titers were determined as previously described (Tsetsarkin et al., PLoS. Pathog. 3, e201 (2007) and Pastorino et al., *J. Virol. Methods* 124, 65 (2005)). Briefly, viral RNA transcribed from plasmid CHIK-LR ic was transfected into BHK-21 cells by electroporation. The supernatants from the transfected cells were aliquotted and the stock virus was titrated and tissue culture infectious dose 50% ($TCID_{50}$) endpoint titers were determined using Vero cells. To produce virus for vertebrate challenge, C6/36 (*Aedes albopictus*) cells grown to confluence in T150 flasks were infected with stock virus at a multiplicity of infection of 0.03. Supernatants were harvested at 48 hours post-infection, aliquotted and titrated to determine $TCID_{50}$ endpoint titers on Vero cells.

Plaque Assay

Serum samples were tested for CHIKV neutralizing antibody by a standard plaque reduction neutralization test (PRNT). Briefly, monkey sera were heat inactivated at 56° C. for 30 minutes and diluted in virus diluent (PBS/5% BSA). Diluted serum samples were mixed with an equal volume of 40 PFU CHIKV (strain LR2006 OPY-1) and incubated for 1 hour at 37° C. Six-well plates of confluent Vero cells were inoculated with 200 μl of the serum-virus mixtures in duplicate and incubated at 37° C. for 1 hour. Plates were overlaid with 3 ml of medium containing 0.9% agarose (Lonza Rockland, Rockland, Me.) and incubated at 37° C. in a 5% $CO_2$ incubator for 2 days. A second overlay medium containing neutral red and 1% agarose was then added and the plates were incubated overnight before plaques were visualized and counted. The viremia in the monkeys after challenge was measured by plaque assay. Six-well plates of confluent Vero cells were inoculated with 200 μl of the serum-PBS mixtures in duplicate. The serum dilutions were 1:200, 1:400, 1:800, 1:1000, 1:10,000 and 1:100,000, since at lower dilutions toxicities were observed in the cells (detection limit 1:200 dilution=1000 PFU/ml).

Passive Transfer of Immunoglobulin and Challenge in IFNα/βR$^{-/-}$ Mice

IFNα/βR$^{-/-}$ mice were kindly given by Robert Seder and Daniel D. Pinschewer. IgG was purified from the serum in monkeys immunized with CHIKV VLPs or injected with PBS (control) using a HiTrap™ Protein G HP column (GE Healthcare) following the manufacturer's recommendations. IgG was further purified using a Melon Gel IgG Purification Kit (Pierce) following the manufacturer's recommendations. Purified IgG was dialyzed 3 times against PBS. 2 mg of purified IgG (from approximately 200 μl of serum) was administered intravenously into each recipient IFNα/βR$^{-/-}$ mouse by tail vein injection 24 hours before challenge. The mice were challenged with 30 PFU of CHIKV (strain LR2006 OPY-1) by intradermal injection.

Detection of CHIKV RNA by Quantitative RT-PCR

For RNA isolation, serum samples were spun down at 10,000×g for 1 hour, liquid poured off and 1 ml of RNA-STAT 60 (Isotex Diagnostics, Friendswood, Tex.) added. Samples were then incubated at RT for 5 min and resuspended in 250 μl of chloroform by vortexing. The samples were spun down at 10,000×g for 1 hour, the aqueous top-layer removed, 0.5 ml isopropanol and 10 μl tRNA (10 μg/ml) added and precipitated overnight at −20° C. Samples were spun down for 1 hour, washed with cold 75% ethanol and spun again for another hour. RNA was resuspended in 30 μl RNAse-free water. For RT-PCR, 10% RNA was added to TaqMan reagents (Applied Biosystems, Foster City, Calif.) along with primers and probe (listed below) and amplified in a 7700 Sequence Detection System (Applied Biosystems). Briefly, the sample was reverse-transcribed at 48° C. for 30 min., held at 95° C. for 10 min, then run for 40 cycles of 95° C. for 30 s and 60° C. for 1 min. The signal was compared to a standard curve of known concentrations of plasmid containing the LR2006 OPY-1 sequence starting at $10^7$ down to 1 copy/mL and multiplied by 10, giving a detection range from 40-$10^8$ copies/mL. All samples were performed in triplicate. The primers and probe were designed to bind to a highly conserved region on the E1 structural protein gene.

```
Primer sequences:
                                        (SEQ ID NO: 62)
CHIK-F
5' AAGCTCCGCGTCCTTTACCAAG 3'
and

                                        (SEQ ID NO: 63)
CHIK-R
5' CCAAATTGTCCTGGTCTTCCT3'.

Probe sequence:
                                        (SEQ ID NO: 64)
CHICK-P
FAM-CCAATGTCTTCAGCCTGGACACCTTT-TAMRA
as described previously in Huang
et al., J. Virol. 78, 12557 (2004) and
Pastorino et al., J Virol. Methods 124,
65 (2005)).
```

Structural Models for Analysis of CHIKV E1/E2 and Surface Area Calculations

The CHIKV E1/E2 (OPY-1 strain) was modeled from PDB accession number 3N40-44 and displayed using Pymol. The electrostatic potential of the E1/E2 surface was calculated using APBS and visualized with Pymol using blue and red to represent positive and negative charges, respectively.

Alignment of Alphaviruses E2 Protein

The representative alphavirus E2 glycoproteins were aligned in the NCBI database to a panel that included Aura virus, Una virus, Mayaro virus, Middelburg virus, O'nyong-nyong virus (strain SG650), Ndumu virus, Barmah Forest virus, Seal louse virus, Salmon pancreas disease virus (SPDV), Whataroa virus, Sindbis virus, Western equine encephalomyelitis virus (WEEV), Venezuelan equine encephalitis virus (VEEV), Ross river virus (strain NB5092), Barmah Forest virus, Bebaru virus, Semliki forest virus, Alphavirus M1, Fort Morgan virus, and Eastern equine encephalitis virus (EEEV). CHIKV strains were aligned using the NCBI protein blast tool.

Flow Cytometry

CHIKV envelope expression on transfected cell membranes was measured by flow cytometry as described previously in Wu et al., *J. Virol.* 83, 5077 (2009), with the CHIKV E2 monoclonal antibody m10-18 or a control mouse monoclonal antibody as a primary antibody and goat anti-mouse immunoglobulins linked to Phycoerythrin as a secondary antibody (Sigma). The data was analyzed and displayed with FlowJo 8.8.6 software (Tree Star).

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All patents and publications mentioned in this specification are herein incorporated by reference to the same extent as if each independent patent and publication was specifically and individually indicated to be incorporated by reference.

SEQUENCE LISTING (172 sequences)

SEQ ID NO: 1 - protein, 16 aa, Artificial Sequence
  Synthetic consensus sequence for NLS
KRPAATKKAGQAKKKK

SEQ ID NO: 2 - protein, 4 aa, Eastern equine encephalitis virus
KRKK

SEQ ID NO: 3 - protein, 4 aa, Western equine encephalitis virus
KKKK

SEQ ID NO: 4 - protein, 5 aa, Venezuelan equine encephalitis virus
KKPKK

SEQ ID NO: 5 - protein, 8 aa, Chikungunya virus
RRNRKNKK

SEQ ID NO: 6 - protein, 4 aa, Ross river virus
RKKK

SEQ ID NO: 7 - protein, 5 aa, Barmah Forest virus
KKPKK

SEQ ID NO: 8 - DNA, 25 bp, Artificial Sequence
  Synthetic primer
ctctagacaccatggagttcatccc

SEQ ID NO: 9 - DNA, 30 bp, Artificial Sequence
  Synthetic primer
tggatcctcattagtgcctgctaaacgaca

SEQ ID NO: 10 - DNA, 20 bp, Artificial Sequence
  Synthetic primer
atatcgcggccgctctagac

SEQ ID NO: 11 - DNA, 30 bp, Artificial Sequence
  Synthetic primer
tggatcctcattagtgcctgctgaacgaca

SEQ ID NO: 12 - DNA, 50 bp, Artificial Sequence
  Synthetic primer
tacccctgagggagccgaagagtggagtcttgccatcccagttatgtgcc

SEQ ID NO: 13 - DNA, 26 bp, Artificial Sequence
  Synthetic primer
ccactcttcggctccctcaggggtaa

SEQ ID NO: 14 - DNA, 50 bp, Artificial Sequence
  Synthetic primer
ttgctctccccaccgccaaagacgcagcaccaaggacaacttcaatgtct

SEQ ID NO: 15 - DNA, 25 bp, Artificial Sequence
  Synthetic primer
gcgtctttggcggtggggagagcaa

SEQ ID NO: 16 - DNA, 50 bp, Artificial Sequence
  Synthetic primer
atgctgcgtcagaacgaccaaggcggccacataccaagaggctgcgatat

SEQ ID NO: 17 - DNA, 25 bp, Artificial Sequence
  Synthetic primer
cgccttggtcgttctgacgcagcat

SEQ ID NO: 18 - DNA, 50 bp, Artificial Sequence
  Synthetic primer
catcggtgcccacactgtgagcgcgtacgaacacgtaacagtgatcccga

SEQ ID NO: 19 - DNA, 25 bp, Artificial Sequence
  Synthetic primer
cgcgctcacagtgtgggcaccgatg

SEQ ID NO: 20 - DNA, 20 bp, Artificial Sequence
  Synthetic primer
atatcgcggccgctctagac

SEQ ID NO: 21 - DNA, 25 bp, Artificial Sequence
  Synthetic primer
gcgtcgctggcggtggggagaacat

SEQ ID NO: 22 - DNA, 50 bp, Artificial Sequence
  Synthetic primer
atgttctccccaccgccagcgacgcagtactaaggacaattttaatgtct

SEQ ID NO: 23 - DNA, 25 bp, Artificial Sequence
  Synthetic primer
tggatcctcattagtgcctgctgaa

SEQ ID NO: 24 - DNA, 40 bp, Artificial Sequence
  Synthetic primer
ccatgctgctgtatcctgaccacccaacactcctgtccta

SEQ ID NO: 25 - DNA, 40 bp, Artificial Sequence
  Synthetic primer
taggacaggagtgttgggtggtcaggatacagcagcatgg

SEQ ID NO: 26 - DNA, 40 bp, Artificial Sequence
  Synthetic primer
tcatgctactgtatcctgaccatccgacactcttgtctta

SEQ ID NO: 27 - DNA, 40 bp, Artificial Sequence
  Synthetic primer
taagacaagagtgtcggatggtcaggatacagtagcatga

SEQ ID NO: 28 - DNA, 31 bp, Artificial Sequence
  Synthetic primer
cattcgtgccacagccctgtcgcattggagc

SEQ ID NO: 29 - DNA, 31 bp, Artificial Sequence
  Synthetic primer
gctccaatgcgacagggctgtggcacgaatg

SEQ ID NO: 30 - DNA, 35 bp, Artificial Sequence
  Synthetic primer
accaagctgcgctatatggataaccatacgccagc

SEQ ID NO: 31 - DNA, 35 bp, Artificial Sequence
  Synthetic primer
gctggcgtatggttatccatatagcgcagcttggt

SEQ ID NO: 32 - DNA, 33 bp, Artificial Sequence
  Synthetic primer
tgcgctatatggatagccatatgccagcggacg

SEQ ID NO: 33 - DNA, 33 bp, Artificial Sequence
  Synthetic primer
cgtccgctggcatatggctatccatatagcgca

SEQ ID NO: 34 - DNA, 33 bp, Artificial Sequence
  Synthetic primer
ggagcgagccggattgtttgtaaggacttcagc

SEQ ID NO: 35 - DNA, 33 bp, Artificial Sequence
  Synthetic primer
gctgaagtccttacaaacaatccggctcgctcc

SEQ ID NO: 36 - DNA, 33 bp, Artificial Sequence
  Synthetic primer
cagaaagatcagccactcatgcacacacccgtt

SEQ ID NO: 37 - DNA, 33 bp, Artificial Sequence
  Synthetic primer
aacgggtgtgtgcatgagtggctgatctttctg

SEQ ID NO: 38 - DNA, 34 bp, Artificial Sequence
  Synthetic primer
cacacacccgttccatcatgatccacctgtgata

SEQ ID NO: 39 - DNA, 34 bp, Artificial Sequence
  Synthetic primer
tatcacaggtggatcatgatggaacgggtgtgtg

SEQ ID NO: 40 - DNA, 33 bp, Artificial Sequence
  Synthetic primer
gtgataggtagggagaagttccactctcgacca

SEQ ID NO: 41 - DNA, 33 bp, Artificial Sequence
  Synthetic primer
tggtcgagagtggaacttctccctacctatcac

SEQ ID NO: 42 - DNA, 29 bp, Artificial Sequence
  Synthetic primer
gcaccgctgccactactgaggagatagag

SEQ ID NO: 43 - DNA, 29 bp, Artificial Sequence
  Synthetic primer
ctctatctcctcagtagtggcagcggtgc

SEQ ID NO: 44 - DNA, 27 bp, Artificial Sequence
  Synthetic primer
ccgcacgctgatgtcgcagcagtctgg

SEQ ID NO: 45 - DNA, 27 bp, Artificial Sequence
  Synthetic primer
ccagactgctgcgacatcagcgtgcgg

SEQ ID NO: 46 - DNA, 40 bp, Artificial Sequence
  Synthetic primer
aagtgatcaataactgcaaagttgatcagtgccatgctgc

SEQ ID NO: 47 - DNA, 40 bp, Artificial Sequence
  Synthetic primer
gcagcatggcactgatcaactttgcagttattgatcactt

SEQ ID NO: 48 - DNA, 38 bp, Artificial Sequence
  Synthetic primer
gctgcagtcactaatcacaagaagtggcaatacaactc

SEQ ID NO: 49 - DNA, 38 bp, Artificial Sequence
  Synthetic primer
gagttgtattgccacttcttgtgattagtgactgcagc

SEQ ID NO: 50 - DNA, 35 bp, Artificial Sequence
  Synthetic primer
cggaaaaaaccaagtcatcatgctgctgtatcctg

SEQ ID NO: 51 - DNA, 35 bp, Artificial Sequence
  Synthetic primer
caggatacagcagcatgatgacttggttttttccg

SEQ ID NO: 52 - DNA, 35 bp, Artificial Sequence
  Synthetic primer
ccgcggtcaccaatcacaaaaattggcagtataac

SEQ ID NO: 53 - DNA, 35 bp, Artificial Sequence
  Synthetic primer
gttatactgccaatttttgtgattggtgaccgcgg

SEQ ID NO: 54 - DNA, 36 bp, Artificial Sequence
  Synthetic primer
ctacaagagcgaccaaacgaattgggtcttcaactc

SEQ ID NO: 55 - DNA, 36 bp, Artificial Sequence
  Synthetic primer
gagttgaagacccaattcgtttggtcgctcttgtag

SEQ ID NO: 56 - DNA, 32 bp, Artificial Sequence
  Synthetic primer
gccgcggtcaccaatcacaataagtggcagta

SEQ ID NO: 57 - DNA, 32 bp, Artificial Sequence
  Synthetic primer
tactgccacttattgtgattggtgaccgcggc

SEQ ID NO: 58 - DNA, 36 bp, Artificial Sequence
  Synthetic primer
gctctagacaccatgagcctcgccctcccggtcttg

SEQ ID NO: 59 - DNA, 30 bp, Artificial Sequence; identical to SEQ ID NO: 9
  Synthetic primer

SEQ ID NO: 60 - DNA, 36 bp, Artificial Sequence
  Synthetic primer
gctctagacaccatgagtcttgccatcccagttatg

SEQ ID NO: 61 - DNA, 30 bp, Artificial Sequence; identical to SEQ ID NO: 11
  Synthetic primer

SEQ ID NO: 62 - DNA, 22 bp, Artificial Sequence
  Synthetic primer
aagctccgcgtcctttaccaag

SEQ ID NO: 63 - DNA, 21 bp, Artificial Sequence
  Synthetic primer
ccaaattgtcctggtcttcct

SEQ ID NO: 64 - DNA, 26 bp, Artificial Sequence
  Synthetic probe
ccaatgtcttcagcctggacaccttt

SEQ ID NO: 65 - protein, 294 aa, Chikungunya virus
KDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLS

SEQ ID NO: 66 - protein, 294 aa, Chikungunya virus
KDNFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLTTTDKVINNCKVDQCHAAVTNHKKWQYNSPLVPRNAELGDRKGKIHIPFPLANVTCRVPKARNPTVTYGKNQVIMLLYPDHPTLLS

SEQ ID NO: 67 - protein, 293 aa, Ross river virus
TEHFNVYKATRPYLAYCADCGDGYFCYSPVAIEKIRDEASDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFS

SEQ ID NO: 68 - protein, 294 aa, Sindbis virus
IDDFTLTSPYLGTCSYCHHTVPCFSPVKIEQVWDEADDNTIRIQTSAQFGYDQSGAASANKYRYMSLKQDHTVKEGTMDDIKISTSGPCRRLSYKGYFLLAKCPPGDSVTVSIVSSNSATSCTLARKIKPKFVGREKYDLPPVHGKKIPCTVYDRLKETTAGYITMHRPRPHAYTSYLEESSGKVYAKPPSGKNITYECKCGDYKTGTVSTRTEITGCTAIKQCVAYKSDQTKWVFNSPDLIRHDDHTAQGKLHLPFKLIPSTCMVPVAHAPNVIHGFKHISLQLDTDHLTLLT

SEQ ID NO: 69 - protein, 294 aa, Western equine encephalitis virus
TDDFTLTSPYLGFCPYCRHSAPCFSPIKIENVWDESDDGSIRIQVSAQFGYNQAGTADVTKFRYMSYDHDHDIKEDSMEKLAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKRDQTKWVFNSPDLIRHTDHSVQGKLHIPFRLTPTVCPVPLAHTPTVTKWFKGITLHLTATRPTLLT

SEQ ID NO: 70 - protein, 291 aa, Eastern equine encephalitis virus
DTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVREGTTSSDYTTTCTDVKQCRAYLIDNKKWVYNSGRLPRGEGDTFKGKLHVPFVPVKAKCIATLAPEPLVEHKHRTLILHLYPDHPTLLT

SEQ ID NO: 71 - protein, 294 aa, Venezuelan equine encephalitis virus
EELFKEYKLTRPYMARCIRCAVGSCHSPIAIEAVKSDGHDGYVRLQTSSQYGLDSSGNLKGRTMRYDMHGTIEEIPLHQVSLHTSRPCHIVDGHGYFLLARCPAGDSITMEFKKGSVTHSCSVPYEVKFNPVGRELYTHPPEHGAEQACQVYAHDAQNRGAYVEMHLPGSEVDSSLISLSGSSVTVTPPVGTSALVKCKCGGTKISETINKAKQFSQCTKKEQCRAYRLQNDKWVYNSDKLPKAAGATLKGKLHVPFLLADGKCTVPLAPEPMITFGFRSVSLKLHPKNPTYLT

SEQ ID NO: 72 - protein, 4 aa, Chikungunya virus
NKKQ

SEQ ID NO: 73 - protein, 5 aa, Chikungunya virus
NKKQR

SEQ ID NO: 74 - DNA, 3747 bp, Artificial Sequence
  Synthetic polynucleotide
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaa

SEQ ID NO: 75 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 76 - DNA, 3744 bp, Artificial Sequence
  Synthetic polynucleotide
atggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaagtggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcac

SEQ ID NO: 77 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaagtggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 78 - DNA, 8185 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcaatgaattacatacctacgcagacgttctacggccgccgatggcgtcctcgcccggcggcccgcccctgggtggctccaccacccgtatactatccaccaccgccacccgtgcctgtcgacccgcaagcgcagcaaatgcaacaacttattgctgcggtcaatacgctggctataaggcagaatggcacccgaacacctggacaacaacgaaggaaacgtcaatcaaacaaaccaaagaggaaacagacacccccgaagaaacagaacccggcgaaaacaaagaacaagcagaaaccgcaaccacccaagcctaagaaacggaaacccggcaagagagaaaggaaatgcatgaagatagagaatgattgcatattcgaggtcaagctcgaaggcaaggtcactgggtacgcctgcctggtaggagataaagtgatgaaaccagcacacgtgaaaggagtcatagataaccctgaccttgccaagctagcttttaagaaatcgagcaagtatgaccttgagtgtgcgcaaattccggtccacatgaagtcagatgcctcgcagttcacccacgagaaaccagaaggacactacaactggcaccatggtgcagtacaatacctgaacggaagatttaccatcccgacaggtgctgggaagccaggggacagcggtaggcctatctttgacaacaagggtcgcgtagtggccattgtgctggggggagccaacgagggagcgaggacggctctatcggttgtcacctggaacaaagacatggttacgcgcatcaccccagaaggaactgaggagtggactgccctggtgacaactgcttgcatcctgagcaatctgactttcgattgcagcctgccaccatgtgcgccttgctgctatgaaaaagacgcagagggcaccctgaggatgctggaggacaacgtcgataaccccggatactacgatctcctggctgcatcaacgcattgtgacgccccgcagcggcgtcgccgcagggggctaactgaggactacgaggcttataaactcactaagccgtacatagcctattgctctgactgcgggaacggacagttttgctacagcccgatagctattgagagagtcagggccgaggcatcggacggaatgctcaagatacagatctctgcgcaaataggcctgcaggtggacggagctcatgcgtggacgaaaatcagatacatgaaagggcacgacgtggaggacacagacaggaactcactggaggtgttcaccaccggagagtgtacggtccatggcaccatggggcatttcatcgtagctacatgccccgaaggtgactccttgacagtggcgttcgttgacaaacataaggtcaggcacgcttgcaggatagcatacaagcatcgtgtccccgtattgggcagagagcactttacggtacggccacatcatggagtagaattgccatgcaccacgtacgccatgagaacatcagtcactaccgaagaaatagaaatgcacgtggcgcatgacgtgcccgacaacacctttctatccaagaccggaaataaagtgaagataacgccaaaaggaaagtctattcgctacaactgcacgtgtgggtctaaggagagcggtgtcacaaagcaagacaaagaatttgacaactgcgaagtttcgcagtgccacaccatggtgaccgcccacgataagtggcagtttaactctccttatgtccctagggcaggctcaggcaagaaaggaaagatccacgtaccctttccactgagcaactctacgtgcagagttccgttggcgcctttaccgaacaccatcccggcaaagaatggaatcacactgcagttgcatccggtcgccccgacgctacttacctaccgcaccctcggagagaaaccagaacaccacacagaatggatatcagaaagttgcgaacgtacactccccgtacctgaggaggggttggagtacacatggggcaatcacgcccctgtgagactgtgggcacaactgacgactaagggttcagcccatgggatgccgcacgaaatcttctcatattactatggattgtaccctgccacgacggttgcagtgtgcgtggggctagcgtgtgtgatcttgctggctctgtccgcgtcctgctgcctgtgcgtgtcagcgagaaataagtgcttgaccccgtacgcgttgacgccaggagccgtggtgccgtgcactttgagcttattgtgctgcgcccccagagccaaggccgcaacgtttgcggagacagcggcatatctatgggacgagaaccagacggtgttctggatgcaattcgcaatccccgtagcatgctttatgatagtgacatattgcctgcgccacttgatgctgtgctgtaggaccgcttcttttttagtggcagtaagcctgggaatgggggcgacccaggcgtatgagcatagtgtaacgctccccaacgcggtcggatttccgtacagagcccatgtagacagaccagggttctctccattaacgctccatatggaggtagtctccactagcctagagccgacgctcgccctggattacgtcacttgcgagtacaaaacggtggtgccgtcgcctaaggtcacctgttgcggcatgtcggagtgtgcacaccagcaaaaagcggactttcaatgtaaagtctacaccggcgtctacccctttttgtggggcggtgcctactgcttttgcaattcggaaaacactcagctgagcgaagcttatgttgagcggagcgaggtgtgcaaacacgatcacgcagcggcgtatcgcgctcatacagccgcattgaaggctaaaatcagagtgacctacggttccacgaacgggacggctgaggcgtttgtcaacggagagagcaccgcacgaattggagacctgaaaatgatcctaggtcccatatccaccgcgtggagcccctttgacccaaagatcgtcgtctacaaggacgaagtctacaatcaggattatccaccgtacggatccgggcaaccgggtagatttggggacttacagagcaggaccaccgagagtaacgatgtgtacgccaatactgcactgaagctggctcgcccatctgccggcacggtgcacgttccatatacccagacgccgtccgggtttaagtattggctaaaagaaaaaggggacgcattgaaccacaaggctcctttcggctgcatcatcaagacgaaccccgtaagggcagaaaattgtgcagtcggaaacataccagtgtctctagacattcccgacgcggcttttacacgcatagtcgacgcaccatcgctaaccggcctgaagtgcgaggtggcgacttgcacgcactcatcggactttggaggcactttggtggtggagtacaagaccgacaaagtggggacgtgcgccgtccactcagaatccaacacggctgttatgcaggagacgagtctgtccgtgacgatggacggccgaggtacgttgcatttctccaccgcctcagcctcaccgtccttcgtactgaaagtgtgcagtagcaaaaccacttgcacagcaaagtgcgtgccgccgaaggaccacgtcgtcccttttcctgccaaccacaacaatgttgtgttcccggacttttccagtactgcagtgtcttggctcacccacactatgggcggagctactgtggtgattgctattgggatcaccatattcttaatagttacttgcatagcttttagtaggcactaggcggccgctctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 79 - DNA, 8387 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttcccatgcaattcaccaactcagcctatcgccagatggagcccatgttcgcaccggcttctcgaggacaagtacagccgtatcggccgcgcacaaagcgccgccaagagccgcaagtcggcaacgctgctattgctgccctcgcgaaccagatgagcgcgctccagctgcaggtggctggacttgccggccaggcaagggtggaccgtcgtggaccgagacgtgttcagaaaaacaagcagaagaagaagaactcttccaacggagaaaaacccaaggagaagaagaagaagcaaaaacaacaggagaagaaagggagcggcggtgaaaaagccaagaagccgcggaaccggcccgggaaggaggtaaggatctccgtaaagcgtgcccgacagagcaccttccccgtgtaccatgacggtgccatatccggctatgcggtgctgattggctcccgcgtgtttaagccagcgcacgtgaagggtaagttcgaccaccccgaactggcggacatcaagttccaggtcgccgaggtcatggacctcgaagcagccgcataccctaagtgcatgcgagaccaggcggctgaaccagcaaccatgatggatggagtgtacaatggggagtacggcaatattcaggagtggaggacaattttgtattcgatgcgagcggcagaggcaagccggggtgacagtggcaggccattcaccgacaactcaggaaaggttgtcggtatcgtcctcggaggaggacccgatggtaggcgcacacgtctctccgtgataggtttcgacaagaagctgaaggccagagagatcgcctacagcgaggccatcccttggacacgcgcaccagctctcctgctgctgcctatggtcatcgcctgcacctacaactccaatacctttgattgctccaaaccgtcctgccaggattgttgcattactgctgaaccaaagaaggccatgactatgctgaaggacaacctgaatgacccgaactactgggacctgctcattgccgtcaccacctgcagttccgcccgaaaaaagagggctgtgtctacgtcgcctgtcgccgtttacgacacacaaattctcgccgcccacgcagctgcctccccgtatagggcgtactgccccgattgtgacggaactgcctgcatctcgccgatagctatcgacgaggtggtaagtagcggtagtgaccacgtccttcgcatccgggtcggttctcaatcgggagtgaccgctaaaggcggtgcggcgggtgaaacctctctgcgatacctgggaagggacggtaaggtttacgccgcggacaacacgcggctcgtggtgcgcaccactgcaaagtgtgacgtgctgcaggccactggccactacattctggccaactgcccagtggggcagagtctcactgttgcggccacactggacggtacccggcatcaatgcaccacggttttcgaacatcaagtaacggagaagttcacaagagaacgcagcaagggccaccacctgtccgatctgaccaagaaatgcaccaggttctccaccaccccgaagaagtccgcgctctatctcgttgatgtgtatgatgctctgccgacttctgtagagatcagcaccgtggtgacatgcaacgaaagacagtgcacagtgagggtgccacccggtaccacagtgaaattcgataagaggtgcaagaacgctgccaaagagaccgtcaccttcaccagcgactcccagacgtttacgtgcgaggagccggtcctaacggccgccagcatcacccagggcaagccgcacctcagatcgtcaatgttgcccagcggaggcaaagaggtgaaagcgaggattccattcccgttcccgccagagactgcgacttgcagagtgagcatcgccccactgccatcgattacctatgaggaaagcgatgttctgctggccggcactgcgaaataccccgtgctgctaactacacggaaccttggtttccatagcaacgccacatctgaatggatccagggtaagtacctgcgccgcatcccggtcacgccccaagggattgaactaatgttgggaaacaacgcaccgctgcacttctggtcatctgtcaggtacgcatctggagacgccgacgcgtacccctgggaacttctggtgcaccacatcaagcaccatccggagtacgcgtgggcgtttgtaggagttgcatgtggcctgctggccgttgcagcatgcatgttcgcgtgcgcatgcaacagggtgcggtactctctgctcgccaacacgttcaacccgaacccaccaccattgaccgcactgactgcagcattgtgctgcatacctggggctcgcgcggatcaaccctacctggacatcattgcctacttgtggaccaacagcaaagtggccttcgggctgcaatgcgcggcgcccgtggcttgcatgctcatcgttacatacgcccttagacattgcagattgtgctgcaattcttttttaggggtaagagggtggtcggctctgctggtcatccttgcgtatgtacagagctgcaaggcgtacgaacacaccgtggtggtcccaatggatccaagagccccgtcgtacgaggcggtgataaaccggaatgggtatgaccccctgaagcttaccatcgcagtgaactttaccgtcatctcaccaactacggctctggaatactggacctgtgcaggagtccctgtcgtcgagccgccccatgtgggctgctgcacgtcagtgtcctgcccctccgacctctccacgctgcacgcgttcaccggcaaagccgtctccgacgtgcactgcgatgtgcacacgaacgtgtaccccttgttgtggggtgcggctcactgcttctgttccactgaaaacacgcaggtcagcgctgtggccgccaccgtttctgagttctgtgctcaggactcagagcgcgccgaggcgttcagcgttcacagcagctcagtcactgcagagattctggtgacgcttggtgaagtggtgacggcggtccacgtttacgtggacggggtaacatcagccaggggtaccgacctcaagatcgtggctggcccaataacaactgactactccccgtttgaccgcaaagtagtccgtatcggcgaagaggtctataattacgactggcctccttacggggctggtcgaccaggcacattcggagacattcaagctaggtcaaccaactatgtcaaacccaatgatctgtacggggacatcggaattgaagtactgcagccgactaatgaccacgtgcacgtggcttacacgtatacgacctctgggttgctgcgttggttgcaggacgctccgaaaccactcagtgtcacagcaccgcacggttgtaagatcagtgctaacccgctcctggccctcgattgtggggttggtgccgtccccatgtccatcaacattccggacgcgaagttcacccgcaaactaaaggacccgaaaccttcggccctgaaatgcgtggtggacagttgcgagtacggggtggactacgggggcgccgccacgatcacctacgagggccacgaggctgggaagtgcgggatccattccctgacaccaggagtccctctgagaacatcagtggttgaagtagttgccggcgctaataccgtcaaaacgaccttctcctcacccacgcccgaggttacactcgaggtagagatctgttcggcaatagtgaagtgcgccagtgagtgcactccaccgaaggaacacgtagtcgcagccaggcctcgccatggcagcgacactggaggctacatctccgggcccgcaatgcgctgggccggaaggattgtagggaaccctagtggtcctgtttcctcatccttggccgtcacctactgcgtggtgaagaagtgccgctctaaaagaatccggatagtcaagagctaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 80 - DNA, 8166 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcacaccatgaattacattccaactcaaaccttttacggacgccgttggcgaccacgcccggcgtaccgtccatggcgggtgccgatgcagccggccccacccatggtgattcctgagctgcaaactccgatcgtccaggcccaacagatgcagcagctaatcagtgcagtttctgccctgacgaccaagcaaaatggcaaagcaccgaagaagccgaagaaaaagccgcaaaaagcgaaggctaagaaaaacgaacagcaaaagaagaacgagaacaagaaaccaccgcctaagcagaagaatccggctaagaagaagaaaccaggaaaaagggaacgcatgtgcatgaagatagagaatgattgcatcttcgaggtcaagcttgacggtaaggtcacgggatacgcctgcctagtcggggataaagtgatgaagccggcacacgtcaaaggtgtgatcgacaaccccgacctagcgaagcttacctacaagaaatcgagcaagtatgacctggagtgcgcccagataccagtgcacatgaagtcagatgcttcaaagtacacccatgaaaaaccagaagggcactacaattggcatcacggtgcagtgcagtacagcggtggcaggttcacaatcccgacaggcgcaggtaaaccaggagacagcggccggccgatcttcgacaacaaaggacgcgtggtggccattgtcctgggaggggccaacgaaggagccaggactgccctatccgtcgtgacctggaccaaagacatggtcacacggtacaccccagaaggaacagaagaatggtccgccgccttgatgatgtgcgtcttagccaacgttacattcccatgctcagagcccgcgtgtgcaccctgttgctatgaaaaacaaccagaacagacactgaggatgttagaggacaacgtggaccgcccgggctactacgacctgctcgaggccacgatgacgtgtaacaatagtgcacgccaccgtcgcagtgtgacgaaacacttcaacgtctacaaggccacgaaaccgtatctagcgtattgcgcggactgcggagacgggcagttctgttacagcccggtggctatagaaaaaattagggatgaggcttccgatggcatgataaaaatccaggtcgcagcgcaaattggcatcaacaaaggaggaacacacgaacacaacaaaatcaggtacatcgccgggcatgacatgaaagaggcaaaccgggactctttacaagtgcatacttccggtgtgtgcgctattcgaggcacgatgggccacttcatcgtggcctactgccctccaggggacgaactaaaggtccagttccaagatgcagaatcgcacacccaggcctgcaaagtgcagtacaaacacgcaccggccccagtaggcagagaaaaattcaccgtcaggccccacttcggtatcgaagtgccatgcacaacgtaccagctgactaccgcaccgacggaggaagagatcgacatgcataccccaccggatatcccagacataacgttgctgtcgcagcagtcaggtaatgtaaagatcacagcaggaggaaaaaccatcagatacaactgcacgtgtggtagtggcaacgtgggcaccaccagtagcgacaagactatcaattcgtgcaaaatagcacagtgccacgctgcggtgactaaccacgataagtggcagtacacctcctcgtttgtccctagagccgaccagttgtctcgcaaaggtaaagtgcacgtacctttccctctgaccaactccacatgcagggtgcctgttgcacgtgcaccaggtgtcacatacggaaagagagaactgacagtgaaactgcacccagatcatcccacgctgttgacgtaccggagtctaggagcagatccgcgcccgtatgaggagtggatagaccgatacgtcgaacggaccataccggtgaccgaagatgggatcgagtacagatggggaaacaacccacccgtgcgcttgtgggcccagctgacaactgaaggcaaaccccatgggtggccgcacgagatcatactctattactatgggctatacccagcagccaccatcgccgccgtctcagccgcgggtctcgcagtcgtactatcgctgctggcgtcatgttacatgttcgccactgcacgccgcaagtgcctgaccccatacgccctgacccccggagctgtcgtcccggtaacactaggagtactatgctgcgcaccacgagcgcatgccgcgtcatttgcggaatctatggcgtatctatgggatgagaatcaaaccctgttttggctggagcttgcaacgccgctcgctgccataatcatacttgtatgctgcctgaagaacctgctttgctgctgcaaaccgctttcttttttagtgctggtgagcctgggaactcccgtcgtaaaatcttacgaacacaccgcaacgatcccgaatgtggtgggattcccgtataaggctcacattgagaggaacggcttctccccgatgaccctacagcttgaagtacttggaaccagcttggaacccacgctaaacttagagtacataacctgtgaatacaagacagtcgtgccatcaccttatatcaagtgctgcgggacatcagaatgcagatccatggagcgccccgactatcaatgccaggtctacacaggagtgtacccatttatgtggggcggcgcatactgcttctgcgacactgagaacacccagctgagtgaagcatacgttgatagatcggacgtatgcaagcacgaccatgccgccgcctacaaggcgcatactgcggcaatgaaagccaccatccgaataagctacgggaacctcaatcagacaacaacggcgttcgtcaacggggagcacacagtgaccgtcggaggcagcaggtttacttttggtccaatctccactgcctggacgcctttcgacaacaagatcgtcgtctacaagaacgacgtctacaaccaggacttcccaccctacgggtcaggacaaccagggaggtttggagacatccagagcaggacggtagagagcaaggacctgtatgccaacaccgccctcaagttgtcaagaccttcgtccggtactgttcacgtgccttacacacagaccccttctggctttaagtactggataaaagagagaggcacgtcgctgaatgacaaggctccctttggatgcgtaatcaagaccaacccagtcagagcagaaaattgcgccgttggcaacatcccagtctccatggacatcccggacaccgcgtttacgcgcgtgattgatgcacctgccgtcacaaacctggagtgccaagtggcggtctgcacgcactcatcggacttcggcgggatcgcgactctgactttcaaaactgacaaacccggaaaatgtgctgtccattctcattcgaacgtagccaccatacaggaggcagctgtggacatcaaaacagatggcaagataaccctgcatttctctacagcatcagcatccccggcattcaaggtatctgtgtgcagtgccaaaacgacatgcatggcagcgtgtgagccgccgaaggaccacatcgtcccttatggggcgagccataacaaccaagtttttcctgacatgtctggcacggcaatgacatgggtgcagcgggtagccggcggactcggcgggctaacactcgccgcagtggcagtacttatactggtgacgtgtgtgactatgcgccgctaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 81 - DNA, 8186 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccgttccaaccaatgtatccgatgcagccaatgccctatcgtaacccgttcgcggccccgcgcaggccctggttccccagaaccgacccttttctggcgatgcaggtgcaggaattaacccgctcgatggctaacctgacgttcaagcaacgccgggacgcgccacctgaggggccacctgctaagaaacctaagagggaggccccgcaaaagcaaaaagggggaggccaagggaagaagaagaagaaccaggggaagaagaaggccaagacggggccgcctaatccgaaggcacagagtggaaacaagaagaagcccaacaagaaaccaggcaagagacagcgcatggtcatgaaattggaatctgacaagacattcccaattatgctggaagggaagattaacggctacgcttgcgtggtcggagggaagttattcaggccgatgcacgtggaaggcaagatcgacaacgacgttctggccgcacttaagacgaagaaagcatccaaatatgatcttgagtatgcagatgtgccacagaacatgcgggccgatacattcaagtacacccatgagaagccccaaggctattacagctggcatcatggagcagtccaatatgaaaatgggcgtttcacggtgccaaaaggagttggggccaagggagacagcggaagacccattctggataatcagggacgggtggtcgctattgtgctgggaggtgtgaatgaaggatctaggacagccctttcagtcgtcatgtggaacgagaagggagtaactgtgaagtatactccggagaactgcgagcaatggtcactagtgaccactatgtgcctgctcgccaatgtgacgttcccatgtgccgaaccaccaatttgctacgacagaaaaccagcagagactttggccatgctcagcgttaacgttgacaacccgggctacgatgagctgctggaagcagctgttaagtgccccggaagaaaaaggagatctaccgaggagctgtttaaggagtataagctaacgcgcccttacatggccagatgcatcagatgtgccgttgggagctgccatagtccaatagcaattgaggcagtgaagagcgacgggcacgacggctatgttagacttcagacttcctcgcagtatggcctggattcctctggcaacttaaagggaaggactatgcggtatgatatgcacgggaccattgaagagataccactacatcaagtgtcactccacacatctcgcccgtgtcacattgtggatgggcatggttattttctgcttgctaggtgcccggcaggggactccatcaccatggaatttaagaaaggttcagtcacacactcctgctcagtgccgtatgaagtgaaatttaatcctgtaggcagagaactctacactcatccaccagaacacggagcagagcaagcgtgccaagtctacgcgcacgatgcacagaacagaggagcttatgtcgagatgcacctcccgggctcagaagtggacagcagtttgatttccttgagcggcagttcagtcaccgtgacacctcctgtcgggactagcgccttggtgaaatgcaagtgcggcggcacaaagatctccgaaaccatcaacaaggcaaaacagttcagccagtgcacaaagaaggagcagtgcagagcatatcgactgcagaatgacaagtgggtgtataattctgacaaactgcccaaagcagcgggagccaccctaaaaggaaaactacacgtcccgttcttgctggcagacggcaaatgcaccgtgcctctagcaccggaacctatgataaccttcggtttccgatcagtgtcactgaaactgcaccctaagaatcccacatatctgaccactcgccaacttgctgatgagcctcattacacgcacgagctcatatctgaaccagctgttaggaattttaccgtcactgaaaaggggtgggagtttgtatggggaaaccatccgccgaaaaggttttgggcacaggaaacagcacccggaaatccacatgggctgccacatgaggtgataactcattattaccacagataccctatgtccaccatcctgggtttgtcaatttgcgccgccattgtaaccgtttccgttgcagcgtccacctggctgttttgcaaatccagagtttcgtgcctaactccttaccggctaacacctaacgccaggatgccgctttgcctggccgtgctttgctgcgcccgcactgcccgggccgagaccacctgggagtccttggatcacctatggaacaataaccaacagatgttctggattcaattgctgatccctctggccgccttgattgtagtgactcgcctgctcaagtgcgtgtgctgtgtagtgccttttttagtcgtggccggcgccgcaggcgccggcgcctacgagcacgcgaccacgatgccgagccaagcgggaatctcgtataacaccatagtcaacagagcaggctacgcgccactccctatcagcataacaccaacaaagatcaagctgatacccacagtgaacttggagtacgtcacctgccactacaaaacaggaatggattcaccagccatcaaatgctgcggatctcaggaatgtactccaactaacaggcctgatgaacagtgcaaagtcttcacaggggtttacccgttcatgtggggaggtgcatattgcttttgcgacactgagaatactcaggtcagcaaggcctacgtaatgaaatctgacgactgccttgcggatcatgctgaagcatacaaagcgcacacagcctcagtgcaggcgttcctcaacatcacagtgggggaacactctattgtgaccaccgtgtatgtgaatggagaaactcctgtgaacttcaatggggtcaaactaactgcaggtccactttccacagcttggacaccctttgacagaaaaatcgtgcagtatgccggggagatctataattacgattttcctgagtatggggcaggacaaccaggagcatttggagacatacaatccagaacagtctcaagctcagatctgtatgccaataccaacctagtgctgcagagacccaaagcaggagcgatccatgtgccatacactcaggcaccatcgggttttgagcaatggaagaaagataaagctccgtcattgaaattcaccgcccctttcggatgcgaaatatatacaaaccccattcgcgccgaaaattgtgctgtagggtcaattccattagcctttgacattcccgacgccttgttcaccagggtgtcagaaacaccgacactttcagcggccgaatgcactcttaacgagtgcgtgtattcatccgactttggcgggatcgccacggtcaagtattcggccagcaagtcaggcaagtgcgcagtccatgtgccatcagggactgctaccctaaaagaagcagcagtcgagctaaccgagcaagggtcggcgaccattcatttctcgaccgcaaatatccacccggagttcaggctccaaatatgcacatcatatgtcacgtgcaaaggtgattgtcaccccccgaaagaccacattgtgacacacccccagtatcacgcccaaacatttacagccgcggtgtcaaaaaccgcgtggacgtggttaacatccctgctgggaggatcggccgtaattattataattggcttagtgctggctactattgtggccatgtacgtgctgaccaaccagaaacataattgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 82 - DNA, 8129 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagtcaacttgactttcaaacaacgatcacctaatccgccgccaggtccaccgccaaagaagaagaagagtgctcctaagccaaaacctactcagcctaaaaagaagaagcagcaagccaagaggacgaaacgcaagcctaaaccagggaaacgacaacgtatgtgtatgaagttggagtcggacaagacatttccgatcatgctgaacggccaagtgaatggatatgcctgcgttgtcggaggaaggctgatgaaaccactccacgttgaaggaaaaattgataatgagcaattagcggccgtgaaattgaagaaggctagcatgtacgacttggagtacggcgacgttccccagaacatgaaatcagacacgctgcagtacaccagcgacaaaccaccgggcttctacaactggcaccacggcgcagtccagtatgagaatgggagatttaccgtaccgagaggagtgggcgggaaaggcgacagcggaagaccgatcctggacaacagaggcagagttgtggctattgttctaggaggtgcaaatgagggcacgcgtacggcgctttcagtggtcacttggaaccagaaaggggtgaccattagggatacccccgaaggttctgaaccgtggtcactagttacagcgctatgcgtgctttcgaatgtcacgttcccatgcgacaaaccacccgtgtgctattcactgacgccagaacgaacactcgacgtgctcgaagagaacgtcgacaatccaaattacgacacgctgctggagaacgtcttgaaatgtccatcacgccggcccaaacgaagcattaccgatgacttcacactgaccagtccctacctggggttctgcccgtattgcagacactcaacgccgtgtttcagcccaataaaaattgagaacgtgtgggacgaatctgatgatggatcgattagaatccaggtctcggcacaattcggctacaatcaggcaggcactgcggatgtcaccaaattccgttacatgtctttcgaccacgaccatgacatcaaggaagacagtatggagaaaatagctatcagcacatctggaccctgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacccgtccatggaaagctggtaaagtgccacgtttacgatcacttgaaggagacgtctgccgggtacataaccatgcacaggccaggcccacacgcgtataagtcctatctggaggaagcgtcaggcgaagtgtacattaaaccaccttctggcaagaacgtcacctacgaatgtaagtgtggcgactacagcacaggtatcgtgagcacgcgaacgaagatgaacggctgcactaaagcaaaacagtgcattgcctacaagagcgaccaaacgaaatgggtcttcaactcgccggatcttattaggcacacagaccactcagtgcaaggtaaattgcacattccattccgcttgacaccgacagtctgcccggttccgttagctcacacgcctacagtcacgaagtggttcaaaggcatcaccctccacctgactgcaatgcgaccaacattgctgacaacgagaaaattggggctgcgagcagacgcaacagcagaatggattacagggtctacatccaggaatttttctgtggggcgagaagggctggagtacgtatggggtaaccatgaaccagtcagagtctgggcccaggagtcggcaccaggcgacccacatggatggccgcatgagatcatcatccactattatcatcggcatccagtctacactgtcattgtgctgtgtggtgtcgctcttgctatcctggtaggcactgcatcatcagcagcttgcatcgccaaagcaagaagagactgcctgacgccatacgcgcttgcaccgaacgcaacggtacccacagcattagcggttttgtgctgcattcggccaaccaacgctgaaacatttggagaaactttgaaccatctgtggtttaacaaccaaccgtttctctgggcacagttgtgcattcctctggcagcgcttgttattctgttccgctgcttttcatgctgcatgccttttttattggttgcaggcgtctgcctggggaaggtagacgccttcgaacatgcgaccactgtgccaaatgttccggggatcccgtataaggcgttggtcgaacgcgcaggttacgcgccacttaacctggagatcacggtcgtctcatcggaattaacaccttcaactaacaaggagtacgtgacctgcaaattccacacagtcattccttcaccacaagttaaatgctgcgggtccctcgagtgcaaggcatcctcaaaggcggattacacatgccgcgtttttggcggtgtgtaccctttcatgtggggaggcgcacaatgcttctgtgacagtgagaacacacaactgagtgaggcgtacgtcgagttcgctccagactgcactatagatcacgcagtcgcactaaaagttcacacagctgctctgaaagtcggcctgcgtatagtatacggcaacaccaccgcgcacctggatacgtttgtcaatggcgtcacgccaggttcctcacgggacctgaaggtcatagcagggccgatatcagccgctttttcaccctttgaccataaggtcgtcatcagaaaggggcttgtttacaactacgacttccctgagtatggagctatgaaaccaggagcgttcggcgatattcaagcatcctcgcttgatgctacagacatagtagcccgcactgacatacggctgctgaagccttctgtcaagaacatccacgtcccctacacccaagcagtatcagggtatgaaatgtggaagaacaactcaggacgacccctgcaagaaacagcaccatttggatgtaaaattgaagtggagcctctgcgagcgtctaactgtgcttacgggcacatccctatctcgattgacatccctgatgcagcttttgtgagatcatcagaatcaccaacaattttagaagttagctgcacagtagcagactgcatttattctgcagactttggtggttctctaacattacagtacaaagctgacagggagggacattgtccagttcactcccactccacgacagctgttttgaaggaagcgaccacacatgtgactgccgtaggcagcataacactacattttagcacatcgagcccacaagcaaattttatagtttcgctatgcggcaagaagtccacctgcaatgctgaatgtaaaccaccggccgaccacataattggagaaccacataaagtcgaccaagaattccaggcggcagtttccaaaacatcttggaactggctgcttgcactgtttgggggagcatcatccctcattgttgtaggacttatagtgttggtctgcagctctatgcttataaacacacgtagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 83 - DNA, 8144 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccataccctacacttaactacccgcctatggcgccgattaacccgatggcttaccgggatcctaatccgcctaggcgcaggtggcggccctttaggccaccacttgcagctcaaattgaggacctgagacgttccatcgctaacctgactttgaaacaacgagcacctaaccctccagcaggaccgcccgccaaacgcaagaagcctgcgccaagcctaagcctgcgcaggaaaaagaagcgaccaccaccacctgccaagaaacaaaaacgtaaacctaaaccaggcaaacgacagcgaatgtgtatgaagctagagtcagataaaacgtttccaatcatgttgaacggacaggtgaatggttacgcgtgcgtcgtgggtggacgagtgttcaaaccgctgcacgtagaaggcagaatagacaatgagcaactggccgccatcaagctgaagaaggccagcatatatgaccttgagtatggtgatgtgccacaatgcatgaaatcagataccctccagtacaccagtgacaagcctcctggcttttataactggcaccatggagctgtacagtatgagaacaataggttcaccgtaccacggggggtcggtggaaagggtgacagcgggagacctattcttgacaacaaaggtagagtcgtcgcaattgtcctgggtggagtcaacgaaggatccaggacggctctatcagtggtgacatggaaccaaaaaggggttacagtcaaagatacaccagaggggtcagagccatggtcgcttgccactgtcatgtgcgtcctggccaatatcacgtttccatgtgatcaaccaccctgcatgccatgctgttatgaaaagaatccacacgaaacactcaccatgttggaacagaattacgacagccgagcctatgatcagctgctcgatgccgctgtgaaatgtaatgctaggagaaccaggagagatttggacactcatttcacccagtataagctggcacgcccgtatattgctgattgccctaactgtgggcatagtcggtgcgacagccctatagctatagaagaagtcagaggggatgcgcacgcaggagtcatccgcatccagacatcagctatgttcggtctgaagacggatggagttgatttggcctacatgagtttcatgaacggcaaaacgcagaaatcaataaagatcgacaacctgcatgtgcgcacctcagccccttgttccctcgtgtcgcaccacggctattacatcctggctcaatgcccaccaggggacacggttacagttgggtttcacgacgggcctaaccgccatacgtgcacagttgcccataaggtagaattcaggccagtgggtagagagaaataccgtcacccacctgaacatggagttgaattaccatgcaaccgttacacccacaagcgtgcagaccaaggacactacgttgagatgcatcaacccgggctagttgccgaccactctctccttagcatccacagtgccaaggtgaaaattacggtaccgagcggcgcccaagtgaaatactactgcaagtgcccagacgtacgagagggaactaccagcagcgactatacaaccacctgcacggatgtcaaacaatgcagggcttacctgattgacaacaaaaaatgggtgtacaactctggaagactgcctcgaggagagggcgacacttttaaaggaaaacttcatgtgccctttgtgcctgttaaggccaagtgcatcgccacgctggcaccagagcctctagttgagcacaaacaccgcaccctgattttacacctgtacccggaccacccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaatccacatggatggccgcacgaagtggtagtctattactacaacagatacccattaaccacaattatcgggttatgcacctgtgtggctatcatcatggtctcttgtgtcacatccgtgtggctcctttgcaggactcgcaatctttgcataaccccgtataaactagccccgaacgctcaagtcccaatactcctggcgttactttgctgcattaagccgacgagggcagatgacaccttgcaagtgctgaattacctgtggaacaacaatcaaaactttttctggatgcagacgcttatcccacttgcagcgcttattgtatgcatgcgcatgctgcgctgcttattttgctgtgggccggcttttttacttgtctgcggcgccttgggcgccgcagcgtacgaacacacagcagtgatgccgaacaaggtggggatcccgtacaaagctttagtcgaacgcccaggttatgcacccgttcacctacagatacagctggttaataccaggataattccatcaactaacctggagtacatcacctgcaagtataagacaaaagtgccttctccagtagtgaaatgctgcggtgccactcaatgtacctccaaaccccatcctgactatcagtgtcaggtgtttacaggtgtttacccattcatgtggggaggagcctactgcttctgcgacactgaaaacacccagatgagcgaggcgtatgtagagcgctcggaagagtgctctattgaccacgcaaaagcttataaagtacacacaggcactgttcaggcaatggtgaacataacttatgggagcgtcagctggagatctgcagatgtttacgtcaatggtgaaactcccgcgaaaataggagatgccaaactcatcataggtccactgtcatctgcgtggtccccattcgataacaaggtggtggttcatgggcatgaagtgtataattacgactttcctgagtacggcaccggcaaagcaggctcttttggagacctgcaatcacgcacatcaaccagcaacgatctgtacgcaaacaccaacttgaagctacaacgaccccaggctggtatcgtgcacacacctttcacccaggcgccctccggcttcgaacgatggaaaagggacaaaggggcaccgttgaacgacgtagccccgtttggctgttcgattgccctggagccgctccgtgcagaaaattgtgcagtgggaagcatccctatatctatagatatacccgatgcggcttttaccagaatatctgaaacaccgacagtctcagacctggaatgcaaaattacggagtgtacttatgcctccgatttcggtggtatagccaccgttgcctacaaatccagtaaagcaggaaactgtccaattcattctccatcaggtgttgcagttattaaagagaatgacgtcactcttgctgagagcggatcatttacattccacttctccactgcaaacatccatcctgcttttaagctgcaggtctgcactagtgcagttacctgcaaaggagattgtaagccaccgaaagaccacatcgtcgattatccagcacaacatactgaatcctttacgtcggcgatatccgccactgcgtggtcgtggctaaaagtgctggtaggaggaacatcagcatttatcgttctggggcttattgctacagcagtggttgccctagttctgttcttccatagacattaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 84 - DNA, 8156 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgaatagaggattctttaacatgctcggccgccgccccttcccggcccccactgccatgtggaggccgcggagaaggaggcaggcggccccgatgcctgcccgcaacgggctggcttctcaaatccagcaactgaccacagccgtcagtgccctagtcattggacaggcaactagacctcaacccccacgtccacgcccgccaccgcgccagaagaagcaggcgcccaagcaaccaccgaagccgaagaaaccaaaaacgcaggagaagaagaagaagcaacctgcaaaacccaaacccggaaagagacagcgcatggcacttaagttggaggccgacagattgttcgacgtcaagaacgaggacggagatgtcatcgggcacgcactggccatggaaggaaaggtaatgaaacctctgcacgtgaaaggaaccatcgaccaccctgtgctatcaaagctcaaatttaccaagtcgtcagcatacgacatggagttcgcacagttgccagtcaacatgagaagtgaggcattcacctacaccagtgaacaccccgaaggattctataactggcaccacggagcggtgcagtatagtggaggtagatttaccatccctcgcggagtaggaggcagaggagacagcggtcgtccgatcatggataactccggtcgggttgtcgcgatagtcctcggtggcgctgatgaaggaacacgaactgccctttcggtcgtcacctggaatagtaaagggaagacaattaagacgaccccggaagggacagaagagtggtccgcagcaccactggtcacggcaatgtgtttgctcggaaatgtgagcttcccatgcgaccgcccgcccacatgctatacccgcgaaccttccagagccctcgacatccttgaagagaacgtgaaccatgaggcctacgataccctgctcaatgccatattgcggtgcggatcgtctggcagaagcaaaagaagcgtcattgacgactttaccctgaccagcccctacttgggcacatgctcgtactgccaccatactgtaccgtgcttcagccctgttaagatcgagcaggtctgggacgaagcggacgataacaccatacgcatacagacttccgcccagtttggatacgaccaaagcggagcagcaagcgcaaacaagtaccgctacatgtcgcttaagcaggatcacaccgttaaagaaggcaccatggatgacatcaagattagcacctcaggaccgtgtagaaggcttagctacaaaggatactttctcctcgcaaaatgccctccaggggacagcgtaacggttagcatagtgagtagcaactcagcaacgtcatgtacactggcccgcaagataaaaccaaaattcgtgggacgggaaaaatatgatctacctcccgttcacggtaaaaaaattccttgcacagtgtacgaccgtctgaaagaaacaactgcaggctacatcactatgcacaggccgagaccgcacgcttatacatcctacctggaagaatcatcagggaaagtttacgcaaagccgccatctgggaagaacattacgtatgagtgcaagtgcggcgactacaagaccggaaccgtttcgacccgcaccgaaatcactggttgcaccgccatcaagcagtgcgtcgcctataagagcgaccaaacgaagtgggtcttcaactcaccggacttgatcagacatgacgaccacacggcccaagggaaattgcatttgcctttcaagttgatcccgagtacctgcatggtccctgttgcccacgcgccgaatgtaatacatggctttaaacacatcagcctccaattagatacagaccacttgacattgctcaccaccaggagactaggggcaaacccggaaccaaccactgaatggatcgtcggaaagacggtcagaaacttcaccgtcgaccgagatggcctggaatacatatggggaaatcatgagccagtgagggtctatgcccaagagtcagcaccaggagaccctcacggatggccacacgaaatagtacagcattactaccatcgccatcctgtgtacaccatcttagccgtcgcatcagctaccgtggcgatgatgattggcgtaactgttgcagtgttatgtgcctgtaaagcgcgccgtgagtgcctgacgccatacgccctggccccaaacgccgtaatcccaacttcgctggcactcttgtgctgcgttaggtcggccaatgctgaaacgttcaccgagaccatgagttacttgtggtcgaacagtcagccgttcttctgggtccagttgtgcatacctttggccgctttcatcgttctaatgcgctgctgctcctgctgcctgccttttttagtggttgccggcgcctacctggcgaaggtagacgcctacgaacatgcgaccactgttccaaatgtgccacagataccgtataaggcacttgttgaaagggcagggtatgccccgctcaatttggagatcactgtcatgtcctcggaggttttgccttccaccaaccaagagtacattacctgcaaattcaccactgtggtcccctccccaaaaatcaaatgctgcggctccttggaatgtcagccggccgctcatgcagactatacctgcaaggtcttcggaggggtctacccctttatgtggggaggagcgcaatgtttttgcgacagtgagaacagccagatgagtgaggcgtacgtcgaattgtcagcagattgcgcgtctgaccacgcgcaggcgattaaggtgcacactgccgcgatgaaagtaggactgcgtattgtgtacgggaacactaccagtttcctagatgtgtacgtgaacggagtcacaccaggaacgtctaaagacttgaaagtcatagctggaccaatttcagcatcgtttacgccattcgatcataaggtcgttatccatcgcggcctggtgtacaactatgacttcccggaatatggagcgatgaaaccaggagcgtttggagacattcaagctacctccttgactagcaaggatctcatcgccagcacagacattaggctactcaagccttccgccaagaacgtgcatgtcccgtacacgcaggcctcatcaggatttgagatgtggaaaaacaactcaggccgcccactgcaggaaaccgcacctttcgggtgtaagattgcagtaaatccgctccgagcggtggactgttcatacgggaacattcccatttctattgacatcccgaacgctgcctttatcaggacatcagatgcaccactggtctcaacagtcaaatgtgaagtcagtgagtgcacttattcagcagacttcggcgggatggccaccctgcagtatgtatccgaccgcgaaggtcaatgccccgtacattcgcattcgagcacagcaactctccaagagtcgacagtacatgtcctggagaaaggagcggtgacagtacactttagcaccgcgagtccacaggcgaactttatcgtatcgctgtgtgggaagaagacaacatgcaatgcagaatgtaaaccaccagctgaccatatcgtgagcaccccgcacaaaaatgaccaagaatttcaagccgccatctcaaaaacatcatggagttggctgtttgcccttttcggcggcgcctcgtcgctattaattataggacttatgatttttgcttgcagcatgatgctgactagcacacgaagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 85 - DNA, 8180 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgaattacatccctacgcaaacgttttacggccgccggtggcgcccgcgcccggcggcccgtccttggccgttgcaggccactccggtggctcccgtcgtccccgacttccaggcccagcagatgcagcaactcatcagcgccgtaaatgcgctgacaatgagacagaacgcaattgctcctgctaggcctcccaaaccaaagaagaagaagacaaccaaaccaaagccgaaaacgcagcccaagaagatcaacggaaaaacgcagcagcaaaagaagaaagacaagcaagccgacaagaagaagaagaaacccggaaaaagagaaagaatgtgcatgaagattgaaaatgactgtatcttcgaagtcaaacacgaaggaaaggtcactgggtacgcctgcctggtgggcgacaaagtcatgaaacctgcccacgtgaaaggagtcatcgacaacgcggacctggcaaagctagctttcaagaaatcgagcaagtatgaccttgagtgtgcccagataccagttcacatgaggtcggatgcctcaaagtacacgcatgagaagcccgagggacactataactggcaccacggggctgttcagtacagcggaggtaggttcactataccgacaggagcgggcaaaccgggagacagtggccggcccatctttgacaacaaggggagggtagtcgctatcgtcctgggcggggccaacgagggctcacgcacagcactgtcggtggtcacctggaacaaagatatggtgactagagtgacccccgaggggtccgaagagtggtccgccccgctgattactgccatgtgtgtccttgccaatgctaccttcccgtgcttccagcccccgtgtgtaccttgctgctatgaaaacaacgcagaggccacactacggatgctcgaggataacgtggataggccagggtactacgacctccttcaggcagccttgacgtgccgaaacggaacaagacaccggcgcagcgtgtcgcaacacttcaacgtgtataaggctacacgcccttacatcgcgtactgcgccgactgcggagcagggcactcgtgtcatagccccgtagcaattgaagcggtcaggtccgaagctaccgacgggatgctgaagattcagttctcggcacaaattggcatagataagagtgacaatcatgactacacgaagataaggtacgcagacgggcacgccattgagaatgccgtccggtcatctttgaaggtagccacctccggagactgtttcgtccatggcacaatgggacatttcatactggcaaagtgcccaccgggtgaattcctgcaggtctcgatccaggacaccagaaacgcggtccgtgcctgcagaatacaatatcatcatgaccctcaaccggtgggtagagaaaaatttacaattagaccacactatggaaaagagatcccttgcaccacttatcaacagaccacagcggagaccgtggaggaaatcgacatgcatatgccgccagatacgccggacaggacgttgctatcacagcaatctggcaatgtaaagatcacagtcggaggaaagaaggtgaaatacaactgcacctgtggaaccggaaacgttggcactactaattcggacatgacgatcaacacgtgtctaatagagcagtgccacgtctcagtgacggaccataagaaatggcagttcaactcacctttcgtcccgagagccgacgaaccggctagaaaaggcaaagtccatatcccattcccgttggacaacatcacatgcagagttccaatggcgcgcgaaccaaccgtcatccacggcaaaagagaagtgacactgcaccttcacccagatcatcccacgctcttttcctaccgcacactgggtgaggacccgcagtatcacgaggaatgggtgacagcggcggtggaacggaccatacccgtaccagtggacgggatggagtaccactggggaaacaacgacccagtgaggctttggtctcaactcaccactgaagggaaaccgcacggctggccgcatcagatcgtacagtactactatgggctttacccggccgctacagtatccgcggtcgtcgggatgagcttactggcgttgatatcgatcttcgcgtcgtgctacatgctggttgcggcccgcagtaagtgcttgaccccttatgctttaacaccaggagctgcagttccgtggacgctggggatactctgctgcgccccgcgggcgcacgcagctagtgtggcagagactatggcctacttgtgggaccaaaaccaagcgttgttctggttggagtttgcggcccctgttgcctgcatcctcatcatcacgtattgcctcagaaacgtgctgtgttgctgtaagagcctttcttttttagtgctactgagcctcggggcaaccgccagagcttacgaacattcgacagtaatgccgaacgtggtggggttcccgtataaggctcacattgaaaggccaggatatagccccctcactttgcagatgcaggttgttgaaaccagcctcgaaccaacccttaatttggaatacataacctgtgagtacaagacggtcgtcccgtcgccgtacgtgaagtgctgcggcgcctcagagtgctccactaaagagaagcctgactaccaatgcaaggtttacacaggcgtgtacccgttcatgtggggaggggcatattgcttctgcgactcagaaaacacgcaactcagcgaggcgtacgtcgatcgatcggacgtatgcaggcatgatcacgcatctgcttacaaagcccatacagcatcgctgaaggccaaagtgagggttatgtacggcaacgtaaaccagactgtggatgtttacgtgaacggagaccatgccgtcacgatagggggtactcagttcatattcgggccgctgtcatcggcctggaccccgttcgacaacaagatagtcgtgtacaaagacgaagtgttcaatcaggacttcccgccgtacggatctgggcaaccagggcgcttcggcgacatccaaagcagaacagtggagagtaacgacctgtacgcgaacacggcactgaagctggcacgcccttcacccggcatggtccatgtaccgtacacacagacaccttcagggttcaaatattggctaaaggaaaaagggacagccctaaatacgaaggctccttttggctgccaaatcaaaacgaaccctgtcagggccatgaactgcgccgtgggaaacatccctgtctccatgaatttgcctgacagcgcctttacccgcattgtcgaggcgccgaccatcattgacctgacttgcacagtggctacctgtacgcactcctcggatttcggcggcgtcttgacactgacgtacaagaccaacaagaacggggactgctctgtacactcgcactctaacgtagctactctacaggaggccacagcaaaagtgaagacagcaggtaaggtgaccttacacttctccacggcaagcgcatcaccttcttttgtggtgtcgctatgcagtgctagggccacctgttcagcgtcgtgtgagcccccgaaagaccacatagtcccatatgcggctagccacagtaacgtagtgtttccagacatgtcgggcaccgcactatcatgggtgcagaaaatctcgggtggtctgggggccttcgcaatcggcgctatcctggtgctggttgtggtcacttgcattgggctccgcagataatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 86 - DNA, 8377 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgcatgtttcccatgcaattcaccaactcagcctatcgccagatggagcccatgtttgcaccgggttcccgaggacaagtacagccgtaccggccgcgcactaagcgccgccaggagccgcaagtcggcaacgccgccattactgccctcgcgaaccagatgagtgcgctccagttgcaggtagctggacttgccggccaggcaagggtggaccgccgtgggccaagacgtgttcagaagaacaagcagaagaagaagaactcttccaacggagaaaaacccaaagagaagaagaagaagcaaaaacaacaggagaagaagggaagcggtggcgaaaaagtcaagaagactaggaaccgacccgggaaggaggtaaggatctccgtaaagtgtgcccgacagagcaccttccccgtgtaccacgaaggtgctatatccggctacgctgtgctgattggatctcgcgtattcaagccggcacacgtgaagggtaagatcgaccaccctgaactggcagacatcaagttccaggtcgccgaggacatggacctcgaagcagctgcgtacccgaagagcatgcgagaccaagcggctgaaccagcgaccatgatggacagagtgtacaactgggagtatggcactatcagagtggaggataatgtcataatcgacgcaagcggtaggggcaagccgggtgacagtggcagggccatcaccgacaactcgggaaaggttgttggtattgtcctcggaggaggacccgatggcaggcgcacacgcctctccgtgataggtttcgacaagaagatgaaggctagggagatcgcctacagtgatgccataccttggacacgcgctccggccctcctgctgctgcctatggttattgtctgcacctacaattccaacaccttcgattgctccaaaccgtcctgccaggactgctgcattactgctgaaccagagaaggccatgaccatgctgaaggacaatctgaacgacccgaactactgggacctactcattgctgtcaccacctgtggctccgcccggagaaagagggctgtgtctacgtcgcctgccgccttttacgacacacagatcctcgccgcccacgcagctgcctccccatacagggcgtactgccccgattgtgacggaacagcgtgtatctcgccgatagccatcgacgaggtggtgagcagtggcagcgaccacgtcctccgcatgcgggttggttctcaatcgggagtgaccgctaagggtggtgcggcgggtgaaacctctctgcgatacctgggaagggacgggaaggttcacgccgcagacaacacgcgactcgtggtgcgcacgactgcaaagtgcgacgtgctgcaggccactggccactacatcctggccaactgcccagtggggcagagcctaaccgttgcggccacactggatggcacccggcatcaatgcaccacggttttcgaacaccaagtaacggagaagttcaccagagaacgcagcaagggccaccatctgtccgacatgaccaagaaatgcaccagattttccactacaccaaaaaagtccgccctctacctcgttgatgtgtatgacgctctgccgatttctgtagagattagcaccgtcgtaacatgcagcgacagccagtgcacagtgagggtgccacctggtaccacagtgaaattcgacaagaaatgcaagagcgctgactcggcaaccgtcactttcaccagcgactcccagacgtttacgtgtgaggagccagtcctaacggctgccagtatcacccagggcaagccacacctcagatcggcaatgttgcctagcggaggcaaggaagtgaaagcaaggatcccgttcccgttcccgccggaaaccgcaacttgcagagtgagtgtagccccactgccgtcgatcacctacgaggaaagcgatgtcctgctagccggtaccgcaaaataccctgtgctgctaaccacacggaaccttggtttccatagcaacgccacatccgaatggatccagggcaagtacctgcgccgcatcccggtcacgcctcaagggatcgagctaacatggggaaacaacgcgccgatgcacttttggtcatccgtcaggtacgcatccggggacgctgatgcgtacccctgggaacttctggtgtaccacaccaagcaccatccagagtacgcgtgggcgtttgtaggagttgcatgcggcctgctggctatcgcagcgtgcatgtttgcgtgcgcatgcagcagggtgcggtactctctggtcgccaacacgttcaactcgaacccaccaccattgaccgcactgactgcagcactgtgttgcataccaggggctcgcgcggaccaaccctacttggacatcattgcctacttgtggaccaacagcaaagtggccttcgggctacaatttgcggcgcccgtggcctgtgtgctcatcattacatacgcccttaggcactgcagattgtgctgcaagtcttttttaggggtaagagggtggtcagccctgctggtcatccttgcgtatgtacagagctgcaagagctacgaacacaccgtggtggtcccaatggatccaagagccccgtcgtacgaagcagtgataaaccggaatgggtatgatccattgaagctgaccatctcagtgaatttcaccgtcatctcaccaactacggctctggaatattggacctgcgcaggagtccccatcgtcgagccgccccatgtgggctgctgcacgtcggtgtcctgcccctctgacctctctacgctgcatgcgtttactggcaaagctgtctccgacgtgcactgcgatgtgcacacaaacgtgtaccccttgttgtggggcgcggctcactgcttctgttccaccgagaatacacaggtcagcgctgtggcagccaccgtttctgagttctgtgcccaggactcagagcgtgccgaagcgttcagcgtacacagcagctcagtcaccgctgaggtcctggtgacgcttggtgaagtggtgacggcagtccacgtttacgtggacggggtaacatcagccaggggcactgacctcaagatcgtggctggaccaataacaaccgactactccccattcgatcgcaaagtagtccgcatcggcgaagaggtctataactatgactggcctccttacggggctggccgaccaggcacattcggagacattcaagctaggtcaaccaactatgtcaaacccaacgatctgtatggggacatcggaattgaagtactgcagccgactaacgaccacgtacatgtggcttacacgtatacgacctctgggttactgcgttggctgcaggacgctccgaaaccactcagtgtcacagcaccgcacggttgtaagatcagtgccaatccgctcctggccctcgattgtggggttggtgccgtccccatgtccatcaacattccggacgcgaagtttacccgcaaattaaaggatccgaaaccatcggccctgaaatgcgtggtggacagctgcgagtacggggtggactacgggggcgccgccacgatcacctacgagggccacgaggccgggaagtgcgggattcattccctgacaccaggagtccccctgagaacatcggtggttgaagtggttgctggcgccaataccgtcaaaacgaccttctcctcacccacgcccgaggttgcactcgaggtagagatctgttcggcaatagtgaagtgcgctggtgagtgcactccaccgaaggaacatgtggtcgcaaccaggcctcgccatggcagcgaccctggaggctacatctccgggcccgcaatgcgctgggccggagggattgtagggaccctagtggtcctgttccttatccttgccgtcatctactgcgtggtgaagaagtgccgctccaaaagaatccggatagtcaagagctaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 87 - DNA, 8179 bp, Artificial Sequence
  Synthetic polynucleotide
  modified_base (1645)..(1646): a, c, t, g, unknown or other
  misc_feature (1645)..(1646): n is a, c, g, or t
  modified_base (1993)..(1994): a, c, t, g, unknown or other
  misc_feature (1993)..(1994): n is a, c, g, or t
  modified_base (2072)..(2072): a, c, t, g, unknown or other
  misc_feature (2072)..(2072): n is a, c, g, or t
  modified_base (2426)..(2427): a, c, t, g, unknown or other
  misc_feature (2426)..(2427): n is a, c, g, or t
  modified_base (2713)..(2713): a, c, t, g, unknown or other
  misc_feature (2713)..(2713): n is a, c, g, or t
  modified_base (3081)..(3081): a, c, t, g, unknown or other
  misc_feature (3081)..(3081): n is a, c, g, or t
  modified_base (3253)..(3253): a, c, t, g, unknown or other
  misc_feature (3253)..(3253): n is a, c, g, or t
  modified_base (3618)..(3620): a, c, t, g, unknown or other
  misc_feature (3618)..(3620): n is a, c, g, or t
  modified_base (3706)..(3722): a, c, t, g, unknown or other
  misc_feature (3706)..(3722): n is a, c, g, or t
  modified_base (3888)..(3890): a, c, t, g, unknown or other
  misc_feature (3888)..(3890): n is a, c, g, or t
  modified_base (3926)..(3927): a, c, t, g, unknown or other
  misc_feature (3926)..(3927): n is a, c, g, or t
  modified_base (4415)..(4415): a, c, t, g, unknown or other
  misc_feature (4415)..(4415): n is a, c, g, or t
  modified_base (4761)..(4763): a, c, t, g, unknown or other
  misc_feature (4761)..(4763): n is a, c, g, or t
  modified_base (4893)..(4897): a, c, t, g, unknown or other
  misc_feature (4893)..(4897): n is a, c, g, or t
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgcatgaattacataccaacccagactttttacggacgccgttggcggcctcgcccggcgttccgtccatggcaggtgccgatgcagccgacacctactatggttacacccatgctgcaagcaccggacctacaggctcaacagatgcaacaactgatcagcgcagtctctgcactaaccaccaaacagaatgtaaaagcaccaaaagggcaacggaaacagaaacagcagaaaccaaaggaaaagaaggaaaaacagaagaaaaagccgacgcnnaagaagaagcagcagcagaaaccaaaaccacaggctaagaagaagaaaccagggagaagagaaagaatgtgcatgaagatcgagaatgactgcatattcgaggtcaaactggacggcaaggttaccggctatgcgtgcctagtcggagataaggtcatgaagccggctcacgttaaaggcacaattgataacccagaccttgcgaagttgacttacaagaaatccagtaagtatgacctcgaatgcgcccagatcccagtgcacatgaagtccgacgcctccaagtacacacatgaaaagcccgaaggtcattacaattggcaccatggagcagtgcagtacagcgnnggaaggtttaccatccccacaggcgccggcaaaccaggagatagcggtaggcctatttttgacaacaaagggcgagtngtggccatcgtgttaggcggggccaacgaaggtgcccgcactgcgctgtctgtggtgacgtggacaaaagacatggtcactcgggtaacgccagaaggaaccgaagagtggtctgccgcgctgatgatgtgtatccttgccaacacctctttcccatgctcgtcacctccctgctacccctgctgctacgaaaaacagccagaacagacactgcggatgctggaagacaacgtgaatagacctgggtactatgagttactggaagcgtccatgacatgcagaaacagatcacgccaccgccgcagtgtaatagagcacttcaatgtgtataaggctactagaccgtacttagcnnactgcgctgactgcggggacgggtacttctgctatagcccggttgctatcgagaagatccgagatgaggcgtctgatggcatgctcaagatccaagtctccgcccaaataggtctggacaaggcaggtacccacgcccacacgaagatgcgatatatggctggtcatgatgttcaggaatctaagagagattccttgagggtgtatacgtccgcagcgtgctctatacatgggacgatgggacacttcatcgtcgcacactgtccaccaggcgactacctcaaggnttcgttcgaggacgcaaattcacacgtgaaggcatgtaaggtccaatacaagcacgacccattgccggtgggtagagagaagtttgtggttagaccacactttggcgtagagctgccatgcacctcataccagctgacaacggctcccaccgacgaggagattgacatgcatacaccgccagatataccggatcgcaccctgctatcacagacggcgggcaacgtcaaaataacagcaggcggcaggactatcaggtacaattgtacctgcggccgtgacaacgtaggcactaccagtactgacaagaccatcaacacatgcaagatagaccaatgccatgctgccgttaccagccatgacaaatggnaatttacctctccatttgttcccagggctgatcagacagccaggaaaggcaaagtgcatgttccattccctttgactaacgtcacctgccgagtgccgttggcacgagcgccggatgtcacctatggtaagaaggaggtgaccctaagattacacccagatcatccgacgcncttctcctataggagtttaggagccgtaccgcacccgtacgaggaatgggttgacaagttctctgagcgcatcatcccagtgacggaagaagggattgagtaccagtggggtaacaacccgccggtccgcctgtgggcgcaactgacgactgagggtaaaccccatggctggccacatgaaatcattcagtactattatggactataccccgccgccactattgccgcagtatccggggcgagtctgatggccctcctaactctagcggccacatgctgcatgctggccaccgcgaggagaaagtgcctaacaccgtacgctttgacgccaggagcggtggtaccgttgacattggggctgcttnnntgcgcaccgagggcgaacgcagcatcatttgctgagactatggcctatctgtgggacgagaacaaaaccctcttttggatggaatnnnnnnnnnnnnnnnnngcgcttgctttgctggcatgctgtatcaaaagcctgatctgctgttgtaagccattttcttttttagtgttactgagcctgggagcctccgcaaaagcttatgagcacacagccacaattccgaacgtggtggggttcccgtataaggctcacattgaaaggaatnnnttctcgcccatgactctgcagcttgaagtggtgganncaagcttggaacccacacttaacctggagtacattacctgcgaatacaagacggtggtcccttcgccatttatcaaatgttgcggaacatcagaatgctcatctaaagagcagccagactaccaatgcaaggtgtacacgggtgtataccctttcatgtggggtggagcttactgtttctgcgactccgagaacacgcagcttagcgaggcctatgtcgacaggtcagacgtttgcaaacatgatcatgcattggcctacaaggcacacacggcctctctaaaagcaacaatcaggatcagctacggcaccatcaaccagaccaccgaggccttcgtcaatggagaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggnagattcggagacatccagagcaggacagtggagagcaaagacttgtatgctaatacggccctaaaactctcaagaccatcacccggggttgtgcatgtgccatacacgcagacaccatccggatttaagtattggctgaaggagaaaggatcttcattgaatacaaaggccccttttggctgcaagataaagaccaatccagtcagagctatggattgtgcagttggcagtatacctgtgtcgatggacatacctgacagtgcattcacacgagtggtagatgccccggctgtaacagacctgagctgccaggtagctgtctgtacacactcctccgatttcggannngttgccacattgtcttacaagacggacaaacccggcaagtgcgccgttcactcacattccaacgtcgcaacgttgcaagaggcgacggtggatgtcaaggaggatggcaaggtcacagtgcacttttctnnnnngtccgcctccccggcattcaaagtgtccgtctgtgacgcaaaaacaacgtgcacggcggcgtgcgagcctccgaaagaccacatcgtcccttatggggcgagccataacaaccaggtctttccggacatgtcaggaactgcgatgacgtgggtacagaggatggccagtgggttaggtgggctggccctcatcgcggtggttgtgctggtcttggtaacctgcataacaatgcgtcggtaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 88 - DNA, 8145 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgaccaccatggagttcataccagcacaaacttactacaatagaagataccagcctagaccctggactcaacgccctactatccaggtgatcaggccaaaaccacgccgaagaaggcctgcaggacaactcgcacaactgatatccgcagtcagcagactagcactgcgtacagttccccagaaaccacgccggacccgaaaaattaagaagcaaaagcaagtaaagcaagaacaacagagtactacgaaccagaagaaaaaggcgccgaaacaaaagcagacccaaaagaaaaagagaccaggacgaagggaaaggatgtgcatgaagattgaaaatgactgcatcttcgaagtcagacatgaaggaaaagtaacggggtatgcatgcctagtaggtgataaggtaatgaaaccagcacacgtgaaaggaactattgacaacgcagacctagcgaagttggcgttcaaaagatcatccaaatatgatctagagtgcgcacagataccagtgcacatgaaatcggacgcctcaaagttcacccatgaaaaaccagaaggctattacaactggcatcacggagcagtacagtattctggagggaggttcacgatccctacaggcgcaggaaagcctggggacagcggaagaccaatctttgacaacaaggggcgtgtcgtggctattgttctaggcggagcaaacgaaggaaccaggacagcactatctgtagtgacttggaataaagacatagtcacaaaaatcacaccagaggggtcagttgaatggagccttgccctccctgtcatgtgcctgttggcaaatacaaccttcccatgttcccaaccgccttgcgcgccgtgctgctacgaaaagaaaccggaagaaaccttgagaatgctggaggacaacgtcatgcaaccaggatattaccagttactcgattcagcattggcctgctcacaacgtcgtcaaaaacgtaatgcaagagaaaacttcaatgtctacaaagtcactaggccgtacttagcccactgtcctgactgcggggagggacactcatgccacagcccaatagcattagaacggatcagaagtgaggcaacagatggtaccttgaaaatccaggtatctctgcaaatcggaataaagacagacgacagccacgattggacgaagctacggtatatggatagccatacacctgtggatgcagaccgatccgggttgtttgtcagaacgtcagcaccgtgcaccatcacgggaacgatgggacatttcatactagcacgctgtccgaaaggagagacgctgacggtaggatttgtagacagtagaaggatcagtcacacgtgcatgcacccgttccgccacgagccaccgctgatagggagagagaagtttcactcccgcccgcagcatggcaaagaactaccttgcagtacatacgtccataccacagcggcaactgctgaggaaatagaagtgcatatgccgccagatacccctgactacacgctgatgacacagcaagcgggaaacgttaagatcacagttgacggccagacggtacgatacaagtgcaaatgtgacggctccaatgaaggattaataaccgctgacaaagtcataaataactgcaaagtagaccaatgccacacagcggttacaaaccacaagaaatggcaatacaattcaccgctgaccccgcggaactccgaacaaggagatagaaaaggtaagatccatatcccatttccactggtgaacacaacctgcagggtaccaaaagcaagaaatccgactgtcacatacggtaaaaacagagtcactctgctgttacatccagaccacccaacactcctttcgtaccgcgccatgggaaggatcccggattaccatgaagagtggataacaaacaagaaggaaataagtatcacagtaccagcagaaggcttagaggttacgtggggtaataatgacccatacaaatattggccccaactgtctacaaatggtactgcgcacgggcacccacatgaaataatcctctattactatgagctgtacccaactaccacaattgctgtactagctgctgcttctatcgtaataacatctttggtaggtctatcattaggcatgtgcatatgcgcgagacgcaggtgcatcacgccatatgagctgactccaggagctaccatcccattcctcctaggtgtactatgctgtgccaggactgcaaaagcagcatcgtactacgaagctgcaacatacctctggaatgagcaacaaccattattttggttacagcttctaatccctctgtcagctgcaattgttgtgtgtaattgcctaaaacttttaccatgctgctgcaaaacattgacttttttagccgtcatgagcatcggtgcccgcactgtgaccgcgtacgagcacgcaacagtgatcccgaacacggtgggagtaccgtgtaagactcttgttagcagaccagggtacagccctatggtcttagaaatggagctacagtcggtcactctggaaccagcattatccttggattacattacgtgtgagtataaaacaatcacaccgtccccgtacgtaaaatgctgtggtacagctgaatgtaaggccaagaacctgccagattataactgcaaagtattcacaggcgtctacccatttatgtggggaggagcatactgcttctgtgacgcagagaacacacagctcagcgaggcacacgttgagaaatcagaatcatgcaaaactgagtttgcatcagcctacagagcccacacagcttcagtatcagctaaactacgtgtcttttaccaagggaataatatcaccgtgtctgcatacgccaatggtgatcatgcagttacggtggaagacgcgaagtttgtcatcggtccactatcgtccgcctggtcaccatttgataataagatcgtggtgtacaaaggcgaagtctacaatatggactatccacctttcggcgcagggaggccaggacagttcggtgacatccagagccgcacgccagacagcaaggacgtctatgcgaatacgcagttaatactgcaaagaccagcggcaggagcaatacacgtgccttactcccaggcaccttcgggctttaagtactggctcaaggaaaaaggggcatcattgcagcatactgcaccatttggctgtcagatagcaacaaacccggtaagagcagtgaactgtgcagtgggcaacataccagtctccattgacatcccagatgcagctttcaccagggtcactgacgctccttccatcacagacatgtcctgcgaagtagcttcgtgtacccattcatctgattttggaggtgccgcagtcataaagtacacagctagtaaaaaaggaaaatgcgccgtgcactctgtaacaaatgcggtcactatccgcgaacctaacgtagatgtcaagggaacagcacaattgcaaattgccttctcgaccgcactagctagtgcggaattcaaggtgcagatctgctccacactggtacactgctcagcgacgtgccatcctcctaaagaccatatagtcaattacccgtcacctcacaccacactaggagtgcaggacatttcaacgacagctatgtcttgggtccagaagattacaggaggagtgggactcgtggttgctatagctgctttgatcttaattatagttctctgcgtatcatttagcagacactaagcggccgctctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 89 - DNA, 8132 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatggacttcctaccaactcaagtgttctatggcagacgctggagaccacgaatgccgccacgcccttggagaccacgcatgcctacaatgcagagaccagaccaacaggcccgacaaatgcagcaattgattgcagcggttagcacgcttgccctgaggcagaatgcagccgcccctcagcgtggaaagaagaagcagccacgcagaaagaaaccaaaaccgcagcccgagaaaccaaagaagcaagaacagaagccgaagcaaaagaaggcccctaaacgaaagccagggagaagagaacgcatgtgcatgaagattgagcatgattgcatcttcgaggttaagcacgaaggtaaagtcacgggttacgcctgccttgtcggtgacaaggtaatgaagccagcacacgttcccggggtgatagacaatgcagatcttgcacgcctgtcgtacaagaaatccagtaagtacgatctggaatgtgcacaaatacccgtggctatgaagtcagatgcttcgaagtacacccatgagaaacccgagggtcattacaactggcactacggcgccgtccagtacacgggaggaagattcacggtgcccacaggagtgggtaagcctggcgacagcggtcggcccatctttgacaacaaagggccggttgtcgcaatagtgctgggaggagccaacgaaggtaccagaaccgccctttccgttgtgacatggaataaagacatggtcacgaagattacacctgaaggcactgtggagtgggcagcctcgacagtgacagccatgtgtcttttgacaaatatatccttcccatgtttccaaccgagctgtgcaccgtgctgctatgaaaaggggcctgagccgacgctgaggatgctggaggagaacgtaaattcagaaggatattacgacctgctgcacgctgccgtgtactgtagaaacagttcaaggtcgaagagaagcactgcaaatcattttaatgcgtataagttgacccgtccatatgtggcttactgcgcagactgcggtatgggtcattcttgccacagcccagccatgatcgaaaatattcaggcggatgcaacagatggcacgctaaaaattcagtttgcttcccaaattggcctgaccaaaacggacacgcacgatcacacaaagattagatatgctgaaggacacgacattgcagaggctgccagatcaacccttaaggtacacagtagcagtgagtgcacggtaaccggcacaatgggacactttatcctggccaaatgtccacctggcgaacgaatcagtgtctcatttgttgattcgaaaaacgaacaccggacctgccggatagcctaccaccatgaacagaggttaatagggcgagaaagattcacggtgcgaccgcatcatggaattgagctaccttgcaccacttatcaattgactaccgccgaaacctctgaagaaattgatatgcacatgccgccggacattccggatagaactatcctttcccaacaatcaggaaatgttaagataacggtgaatggacgaaccgtcaggtacagctcttcttgcggttcccaagccgtcgggacaacaaccacagacaagaccattaatagctgtaccgttgacaaatgtcaggcttacgtcacgagccacacaaaatggcaattcaattcaccttttgtcccacgtcggatgcaagcagagcgcaagggcaaagtgcatatcccctttccccttattaacaccacctgccgtgtaccgctggctcccgaggcccttgttaggagcggtaaacgcgaagctacactttcattgcaccctatccaccccacattgctaagttacagaacatttggagcggagcgggtctttgacgagcagtggatcaccgcccagacggaggtaacgatcccggtacctgtggagggagtggagtaccagtggggcaaccataaacctcaacgttttgtggtcgcactgacgactgaaggcaaagcacatggatggcctcatgaaattattgaatactactacggactgcatcctacgacaaccattgtcgtggtgattcgtgtctcagtggtggtgcttctgtcattcgccgcctcggtctacatgtgcgtggtagcacgaaccaaatgtctgacaccatatgcactcacgccgggagctgttgttcctgttaccattggggtgctgtgttgcgcaccgaaagcacatgcagccagtttcgcagaaggtatggcctatctgtgggataacaatcagtcgatgttctggatggagctgaccggaccattggccctccttattctggctacatgctgcgcccgatcactgctttcctgctgcaaggggtcttttttagtcgcaatgagcatcgggagtgccgttgccagtgcttacgagcacacggcaattattccgaaccaagtgggattcccgtataaggctcatgttgcgcgtgaaggttacagtcctttgaccctgcagatgcaggtgatagagaccagccttgagccaacactcaacctggagtatatcacttgcgattacaaaacaaaagttccatcaccatacgtaaagtgctgcggcacggcagaatgccgcacacaggacaagcctgagtacaaatgtgcagtgttcacaggtgtgtatccttttatgtggggaggtgcatactgtttttgtgattcggagaacacacagatgagcgaagcctacgtggagcgcgctgacgtgtgtaaacacgaccacgcagctgcctaccgtgcccacaccgcatcccttagagcaaaaattaaggtgacatacggtactgtgaaccagacagttgaggcgtatgtgaacggtgaccatgccgtaacgattgccggaacaaaatttatttttgggccagtgtcaacgccttggacaccgttcgatacaaaaattctggtttacaaaggggagttatacaatcaggacttcccacggtatggtgccgggcagcctggaagatttggggacattcagagccggacgctggatagtcgagacctatatgccaacacgggcctcaagctggcacgaccggcagccggcaacattcacgtcccctatacccagactccatctggctttaaaacatggcaaaaagacagggactcaccgcttaacgccaaggcgccttttggatgcataatccagacaaatccggtccgagccatgaactgcgccgtcggcaacatacccgtttcgatggatatcgccgacagcgccttcacaagattgaccgacgcgcctgtaatctctgagttgacgtgcactgtgtctacatgcacgcactcatcggattttggcgggatcgctgtactttcctacaaggtggaaaaatcaggcaggtgcgacatccattcacattcaaacgtcgcggtactccaggaagtttccatcgagacagaaggtcgatcagtgatccacttctcaaccgcatcagcctccccttccttcgtagtttctgtttgtagttcgcgtgctacgtgcacagcgaaatgtgaaccaccgaaagaccacgttgttacatatccagcaaatcataacggggtaactttgccagacttatctagcactgccatgacgtgggcacaacatcttgccggcggagttgggttgctgatagctctggccgtgctaattctggtaatagttacttgtgtgactttgagaaggtaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 90 - DNA, 8134 bp, Artificial Sequence
  Synthetic polynucleotide
  modified_base (2169)..(2169): a, c, t, g, unknown or other
  misc_feature (2169)..(2169): n is a, c, g, or t
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagaccaggccctggatccatggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacagaagaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtggtcggcggccgcactgnatataacagcactatgtgtcctccagaacttatcgttcccgtgtgatgcaccaccatgtgcaccatgctgttacgaaaaagaccctgcagggaccctaagattgctgtctgaccactactaccaccccaagtattatgaattacttgactcgacgatgcactgcccacaaggaaggagacctaagaggtctgttgcgcatttcgaagcctacaaggctacgagaccgtatatagggtggtgcgcagattgtggactggcaggatcatgcccatcccctgtgagcatcgagcacgtctggagtgatgccgacgacggcgtactgaagatccaagtgtccatgcagatcggtatagctaaaagcaatactattaaccacgctaagatacgttacatgggtgccaatggagtacaggaggctgaacgctctaccctaagtgtatccacaacagcaccatgtgacatcttggcgaccatgggccatttcatcttggcccgctgccgacccggcagtcaagttgaagtatcactaagcaccgatccaaagctgctatgccgtacaccattctcccacaagcccaggtttattggcaatgaaaagtccccagcacccaccgggcacaagacccgaattccctgcaaaacttactcccatcagacagacttaacgagagaagagattacaatgcatgtaccgccggatgtccccatccaagggctagtgtccaatacaggtaagtcgtactcattagacccaaagacgaagaccatcaagtacaaatgcacttgcggcgagactgtaaaagaaggtactgctacgaacaaaatcacactgttcaattgtgacaccgccccaaagtgtattacatatgcagtggataacacagtgtggcagtacaactcccaatacgtgcccaggtccgaagttacggaggtgaaaggaaagatccatgtgcctttccctctgaccgacagcacgtgtgcagtcagcgtagcacctgaaccgcaagtgacatacagactgggggaagtggagttccacttccaccctatgtaccccaccctcttctccattaggagcctcggaaaggatccgagccacagtcaagaatggatagatacacccatgagcaagacaatccaagttggggcagaaggcgtggagtatgtctggggaaacaacaacccggtacgactatgggcacagaagagctcatcgagcagcgcgcatggtaaccctattagcatagtctcacattactatgacctgtacccttactggaccatcacagtactagcgagtctaggcttgctaatagtgattagttccggtttttcatgctttttgtgttcagtcgctcgaaccaaatgccttacaccctatcaattagcaccaggcgcccaattacccacatttatagcactcctttgctgcgctaagtctgcacgcgcagacactttagatgatttttcctacctgtggaccaacaaccaagccatgttttggctccaactggcatctccggttgcagcgttcttgtgcttatcctattgctgtagaaatctagcatgctgtatgaagatttttttagggataagcggcctgtgtgtaattgccacgcaggcctacgagcactcaaccacgatgccgaatcaggtgggaataccgtttaaagccttgatagagcgaccaggttacgcaggcctcccgctatctttagtagtgattaagtcagaattagtcccctcattagttcaggattatattacctgcaactacaagactgtggtcccgtctccgtacattaaatgttgcggaggcgctgagtgttcacacaaaaatgaagcggactataagtgctcggtgttcacaggcgtgtacccgtttatgtggggaggcgcctactgcttctgtgacaccgaaaacagtcagatgagtgaagtatacgtaaccagaggagaatcatgcgaggctgaccatgccatcgcttatcaggtacacacagcatcgcttaaggcacaagtaatgatatcgattggagaactgaaccaaaccgtcgacgtgtttgtcaacggagacagtccagccagaatccaacaatcaaagttcatacttgggccgatatccagtgcctggtctccttttgatcacaaggtgatcgtatacagggatgaggtgtacaatgaagactacgcaccgtacggatccggccaagcaggcaggttcggagacatccaaagtagaactgttaacagcactgatgtctatgccaacaccaatttgaagcttaaaagaccggcttcaggcaatgttcatgtaccatacacgcaaaccccttcgggtttctcgtactggaaaaaagagaagggagtaccattgaatcgaaacgccccttttggctgtatcatcaaagtcaatccagtacgtgctgaaaactgcgtatatggcaacataccgatcagtatggatattgcggacgcgcacttcacaaggatcgatgaatccccgtctgtgtccttgaaggcgtgtgaagtgcagtcctgcacttattcatcggattttggcggagtagcgagcatttcctacacatctaataaggtaggtaagtgtgccatccacagccactcgaactccgcaacgatgaaggattctgtgcaggatgtccaggaaagcggcgccttgtcgcttttctttgcgacttcctctgtcgagccgaacttcgtggtccaagtgtgtaacgcgcggatcacttgccatggtaagtgtgaaccaccgaaagaccacatcgtaccatacgcagccaaacacaacgacgccgagtttccatccatctctactacagcttggcaatggttggcacacaccacctcagggccactcaccatacttgtggtagctattatagtcgttgttgtagtatccattgtagtatgtgcaagacactagagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 91 - DNA, 8153 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgaactctgtcttttacaatccgtttggccgaggtgcctacgctcaacctccaatagcatggaggccaagacgtagggctgcacctgcgcctcgaccatccgggttgactacccagatccaacagctcactagggctgttagagctttggtgctggacaatgctacacgtcgccagcgcccggctcctcgcacgcgcccgaggaagccgaagactcaaaaacctaagccgaagaagcaaaaccagaaaccaccacaacagcagaagaaagggaaaaatcagccccaacaaccgaagaaaccgaagcccggtaaacgacagcgtaccgccctgaaatttgaagccgaccgcacatttgtcgggaagaatgaagacggcaagattatgggatacgccgttgccatggaagggaaagtgataaaaccactacatgtaaaaggaaccattgaccacccggccctagcgaaacttaaattcactaaatcttcttcttacgacatggagtttgctaaactaccgaccgaaatgaaaagcgacgcattcgggtatacaacggaacaccccgaagtattttacaactggcatcacggagctgtccaattttccggcggaaggttcaccatccctacaggagtcggaggccccggagatagcggaaggcctatactggataactccggaaaagtggtagccatagtcctaggaggagctaatgaagtgccaggaacggcactttctgttgtcacctggaataagaagggagccgctattaaaaccacccacgaagatactgtagagtggtcgcgggctattaccgctatgtgcatcctgcagaacgtcacattcccatgtgaccgaccgccaacttgctataatcgtaatcctgacttgaccctaaccatgttggaaacaaatgtcaatcacccttcgtacgacgttctgctggacgctgctctgaggtgccccacgagacggcacgtcagatcaacgcccaccgatgacttcactctcacagcaccgtacctcggcttgtgtcacagatgtaagacgatggaaccatgctacagccctataaaaatcgaaaaagtgtgggatgatgccgatgacggagttctccgtatacaagtaagtgcccagttagggtacaacagggcgggcactgcagctagcgcccgactccggttcatgggcggaggagtgcctccggaaatccaggagggagcaattgcagattttaaggtcttcacgtccaaaccatgtttacacctatcacataaaggatactttgtcattgtcaagtgccctcctggtgatagtattacaacatcattgaaagtgcatggctcggatcaaacctgcacaattccaatgcgagtaggttacaagttcgtaggcagggaaaaatatactctgccaccaatgcatgggacacaaataccttgccttacctacgaaaggacacgagagaaaagtgcaggatacgtgaccatgcatcgtcccggacaacaatccataaccatgctgatggaagagagcggaggggaggtgtacgtacaaccgaccagtgggcgaaacgtcacctacgagtgtaaatgcggagactttaaaactgggactgtcactgcgcgcactaaaatagacggctgtacagaaaggaaacaatgcattgcgatttctgccgaccacgtcaaatgggtgtttaactcccctgacttgatcaggcataccgaccacacagcccaagggaagttgcatataccattcccgctacagcaggctcaatgtacagtaccactggcgcaccttccaggcgttaagcatgcttatcgcagtatgtctctgacactgcacgctgagcatcctacattgcttactacccgccatcttggagaaaatcctcagcccactgcagaatggattgtcgggagtgtaactcgaaacttctccataaccatacaagggttcgagtatacttggggaaatcagaaaccggtccgagtgtacgcgcaggaatcggcacctggcaatcctcatggctggccacatgaaatcgtacgccattactaccacctctatcccttctacaccgttacagtgctgagcggcatgggactggccatatgcgctggcttagtgatcagtattttatgctgctgcaaagcaagaagggattgcctaacaccttaccaactggccccgaacgctaccgtaccatttctggtaacattgtgttgctgtttccaacggacttcagcggatgaatttaccgataccatggggtacctatggcaacacagtcaaacaatgttctggatacaattggtcatacctttagcagcagtgataactttggttagatgttgctcctgctgtctaccttttttattggttgccagtcctcctaacaaagcggacgcctacgaacatacgatcactgtcccaaatgcgccgttgaactcgtataaagcactagtggaacggcctgggtatgcccccttgaatcttgaagtcatggtcatgaacacccagatcataccatcggttaaacgtgaatacattacctgcaggtaccacaccgttgttccttcaccgcagattaaatgttgcggaactgtcgaatgcccgaaaggtgaaaaagcagactatacctgcaaggtgttcactggtgtgtacccatttctgtggggaggagcacagtgtttttgcgactccgaaaacagtcagcttagcgacaagtacgtcgaactgtcaacagattgcgccacagaccatgccgaggcggtcagagtacacacggcttcggtgaaatcacagctccgaataacctacgggaactccacagcacaagtagacgtatttgtcaacggtgtgactccagccaggagcaaagacatgaaattgatagccggcccattatctactacattttccccgtttgataataaggtcattatatatcatgggaaagtctataactatgacttcccggaatttggggccggaacacctggagctttcggagatgtccaagcgtcatccaccaccggatcagatctattagcaaacacagcaattcatttgcagaggccggaagccagaaacatacacgtcccgtacacccaagctccaagcgggttcgaattctggaagaataacagcggtcagcctttatctgacactgcccctttcggatgcaaagtcaatgtcaacccgctacgtgcagacaagtgtgccgtgggatcactcccgatatccgtggatataccggacgctgcatttacacgcgtatccgagcccctgccatcactgcttaagtgcaccgttactagttgcacatactctacagactatggcggagtgctcgtgttgacatacgagtcggatcgcgcggggcaatgcgctgtacactcgcattcatcaacagcggtactgcgagacccatcggtatacgtcgagcaaaaaggggagactacacttaaatttagtacgcgttccttgcaggcagacttcgaggtatcgatgtgcggaacgagaaccacttgccatgcccaatgtcaaccaccaacggaacacgtaatgaacagaccccagaagtcgactccagacttctcctcagcgatatccaaaacatcatggaactggattacagcgcttatggggggaatttccagtatagctgctatagccgcaattgtgctggtcatagcattagtatttacagcacaacacagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 92 - DNA, 7494 bp, Artificial Sequence
  Synthetic polynucleotide
atgagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcacatgagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaagtggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcacatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtgg

SEQ ID NO: 93 - DNA, 13756 bp, Artificial Sequence
  Synthetic polynucleotide
atggctgcgtgagacacacgtagcctaccagtttcttactgctctactctgcaaagcaagagattaataacccatcatggatcctgtgtacgtggacatagacgctgacagcgcctttttgaaggccctgcaacgtgcgtaccccatgtttgaggtggaaccaaggcaggtcacaccgaatgaccatgctaatgctagagcgttctcgcatctagctataaaactaatagagcaggaaattgaccccgactcaaccatcctggatatcggcagtgcgccagcaaggaggatgatgtcggacaggaagtaccactgcgtctgcccgatgcgcagtgcggaagatcccgagagactcgccaattatgcgagaaagctagcatctgccgcaggaaaagtcctggacagaaacatctctggaaagatcggggacttacaagcagtaatggccgtgccagacacggagacgccaacattctgcttacacacagacgtctcatgtagacagagagcagacgtcgctatataccaagacgtctatgctgtacacgcacccacgtcgctataccaccaggcgattaaaggggtccgagtggcgtactgggttgggttcgacacaaccccgttcatgtacaatgccatggcgggtgcctacccctcatactcgacaaactgggcagatgagcaggtactgaaggctaagaacataggattatgttcaacagacctgacggaaggtagacgaggcaagttgtctattatgagagggaaaaagctaaaaccgtgcgaccgtgtgctgttctcagtagggtcaacgctctacccggaaagccgcaagctacttaagagctggcacctgccatcggtgttccatttaaagggcaaactcagcttcacatgccgctgtgatacagtggtttcgtgtgagggctacgtcgttaagagaataacgatgagcccaggcctttatggaaaaaccacagggtatgcggtaacccaccacgcagacggattcctgatgtgcaagactaccgacacggttgacggcgaaagaatgtcattctcggtgtgcacatacgtgccggcgaccatttgtgatcaaatgaccggcatccttgctacagaagtcacgccggaggatgcacagaagctgttggtggggctgaaccagagaatagtggttaacggcagaacgcaacggaatacgaacaccatgaaaaattatctgcttcccgtggtcgcccaagccttcagtaagtgggcaaaggagtgccggaaagacatggaagatgaaaaactcctgggggtcagagaaagaacactgacctgctgctgtctatgggcattcaagaagcagaaaacacacacggtctacaagaggcctgatacccagtcaattcagaaggttcaggccgagtttgacagctttgtggtaccgagtctgtggtcgtccgggttgtcaatccctttgaggactagaatcaaatggttgttaagcaaggtgccaaaaaccgacctgatcccatacagcggagacgcccgagaagcccgggacgcagaaaaagaagcagaggaagaacgagaagcagaactgactcgcgaagccctaccacctctacaggcagcacaggaagatgttcaggtcgaaatcgacgtggaacagcttgaggacagagcgggcgcaggaataatagagactccgagaggagctatcaaagttactgcccaaccaacagaccacgtcgtgggagagtacctggtactctccccgcagaccgtactacgtagccagaagctcagtctgattcacgctttggcggagcaagtgaagacgtgcacgcacaacggacgagcagggaggtatgcggtcgaagcgtacgacggccgagtcctagtgccctcaggctatgcaatctcgcctgaagacttccagagtctaagcgaaagcgcaacgatggtgtataacgaaagagagttcgtaaacagaaagctacaccatattgcgatgcacggaccagccctgaacaccgacgaagagtcgtatgagctggtgagggcagagaggacagaacacgagtacgtctacgacgtggatcagagaagatgctgtaagaaggaagaagccgcaggactggtactggtgggcgacttgactaatccgccctaccacgaattcgcatatgaagggctaaaaatccgccctgcctgcccatacaaaattgcagtcataggagtcttcggagtaccgggatctggcaagtcagctattatcaagaacctagttaccaggcaggacctggtgactagcggaaagaaagaaaactgccaagaaatcaccaccgacgtgatgagacagagaggtctagagatatctgcacgtacggttgactcgctgctcttgaatggatgcaacagaccagtcgacgtgttgtacgtagacgaggcgtttgcgtgccactctggaacgctacttgctttgatcgccttggtgagaccaaggcagaaagttgtactttgtggtgacccgaagcagtgcggcttcttcaatatgatgcagatgaaagtcaactataatcacaacatctgcacccaagtgtaccacaaaagtatctccaggcggtgtacactgcctgtgaccgccattgtgtcatcgttgcattacgaaggcaaaatgcgcactacgaatgagtacaacaagccgattgtagtggacactacaggctcaacaaaacctgaccctggagacctcgtgttaacgtgcttcagagggtgggttaaacaactgcaaattgactatcgtggatacgaggtcatgacagcagccgcatcccaagggttaaccagaaaaggagtttacgcagttagacaaaaagttaatgaaaacccgctctatgcatcaacgtcagagcacgtcaacgtactcctaacgcgtacggaaggtaaactggtatggaagacactttccggcgacccgtggataaagacgctgcagaacccaccgaaaggaaacttcaaagcaactattaaggagtgggaggtggagcatgcatcaataatggcgggcatctgcagtcaccaaatgaccttcgatacattccaaaataaagccaacgtttgttgggctaagagcttggtccctatcctcgaaacagcggggataaaactaaatgataggcagtggtctcagataattcaagccttcaaagaagacaaagcatactcacctgaagtagccctgaatgaaatatgtacgcgcatgtatggggtggatctagacagcgggctattttctaaaccgttggtgtctgtgtattacgcggataaccactgggataataggcctggagggaaaatgttcggatttaaccccgaggcagcatccattctagaaagaaagtatccattcacaaaagggaagtggaacatcaacaagcagatctgcgtgactaccaggaggatagaagactttaaccctaccaccaacatcataccggccaacaggagactaccacactcattagtggccgaacaccgcccagtaaaaggggaaagaatggaatggctggttaacaagataaacggccaccacgtgctcctggtcagtggctataaccttgcactgcctactaagagagtcacttgggtagcgccgttaggtgtccgcggagcggactacacatacaacctagagttgggtctgccagcaacgcttggtaggtatgacctagtggtcataaacatccacacaccttttcgcatacaccattaccaacagtgcgtcgaccacgcaatgaaactgcaaatgctcgggggtgactcattgagactgctcaaaccgggcggctctctattgatcagagcatatggttacgcagatagaaccagtgaacgagtcatctgcgtattgggacgcaagtttagatcgtctagagcgttgaaaccaccatgtgtcaccagcaacactgagatgtttttcctattcagcaactttgacaatggcagaaggaatttcacaactcatgtcatgaacaatcaactgaatgcagccttcgtaggacaggtcacccgagcaggatgtgcaccgtcgtaccgggtaaaacgcatggacatcgcgaagaacgatgaagagtgcgtagtcaacgccgctaaccctcgcgggttaccgggtggcggtgtttgcaaggcagtatacaaaaaatggccggagtcctttaagaacagtgcaacaccagtgggaaccgcaaaaacagttatgtgcggtacgtatccagtaatccacgctgttggaccaaacttctctaattattcggagtctgaaggggaccgggaattggcagctgcctatcgagaagtcgcaaaggaagtaactaggctgggagtaaatagtgtagctatacctctcctctccacaggtgtatactcaggagggaaagacaggctgacccagtcactgaaccacctctttacagccatggactcgacggatgcagacgtggtcatctactgccgcgacaaagaatgggagaagaaaatatctgaggccatacagatgcggacccaagtagagctgctggatgagcacatctccatagactgcgatattgttcgcgtgcaccctgacagcagcttggcaggcagaaaaggatacagcaccacggaaggcgcactgtactcatatctagaagggacccgttttcatcagacggctgtggatatggcggagatacatactatgtggccaaagcaaacagaggccaatgagcaagtctgcctatatgccctgggggaaagtattgaatcgatcaggcagaaatgcccggtggatgatgcagacgcatcatctccccccaaaactgtcccgtgcctttgccgttacgctatgactccagaacgcgtcacccggcttcgcatgaaccacgtcacaagcataattgtgtgttcttcgtttcccctcccaaagtacaaaatagaaggagtgcaaaaagtcaaatgctctaaggtaatgctatttgaccacaacgtgccatcgcgcgtaagtccaagggaatatagatcttcccaggagtctgcacaggaggcgagtacaatcacgtcactgacgcatagtcaattcgacctaagcgttgatggcgagatactgcccgtcccgtcagacctggatgctgacgccccagccctagaaccagcactagacgacggggcgacacacacgctgccatccacaaccggaaaccttgcggccgtgtctgattgggtaatgagcaccgtacctgtcgcgccgcccagaagaaggcgagggagaaacctgactgtgacatgtgacgagagagaagggaatataacacccatggctagcgtccgattctttagggcagagctgtgtccggtcgtacaagaaacagcggagacgcgtgacacagcaatgtctcttcaggcaccaccgagtaccgccacggaaccgaatcatccgccgatctccttcggagcatcaagcgagacgttccccattacatttggggacttcaacgaaggagaaatcgaaagcttgtcttctgagctactaactttcggagacttcttaccaggagaagtggatgacttgacagacagcgactggtccacgtgctcagacacggacgacgagttaagactagacagggcaggtgggtatatattctcgtcggacaccggtccaggtcatttacaacagaagtcagtacgccagtcagtgctgccggtgaacaccctggaggaagtccacgaggagaagtgttacccacctaagctggatgaagcaaaggagcaactattacttaagaaactccaggagagtgcatccatggccaacagaagcaggtatcagtcgcgcaaagtagaaaacatgaaagcagcaatcatccagagactaaagagaggctgtagactatacttaatgtcagagaccccaaaagtccctacttaccggactacatatccggcgcctgtgtactcgcctccgatcaacgtccgattgtccaatcccgagtccgcagtggcagcatgcaatgagttcttagctagaaactatccaactgtctcatcataccaaattaccgacgagtatgatgcatatctagacatggtggacgggtcggagagttgcctggaccgagcgacattcaatccgtcaaaactcaggagctacccgaaacagcacgcttaccacgcgccctccatcagaagcgctgtaccgtccccattccagaacacactacagaatgtactggcagcagccacgaaaagaaactgcaacgtcacacagatgagggaattacccactttggactcagcagtattcaacgtggagtgtttcaaaaaattcgcatgcaaccaagaatactgggaagaatttgctgccagccctattaggataacaactgagaatttagcaacctatgttactaaactaaaagggccaaaagcagcagcgctattcgcaaaaacccataatctactgccactacaggaagtaccaatggataggttcacagtagatatgaaaagggacgtaaaggtgactcctggtacaaagcatacagaggaaagacctaaggtgcaggttatacaggcggctgaacccttggcgacagcatacctatgtgggattcacagagagctggttaggaggctgaacgccgtcctcctacccaatgtacatacactatttgacatgtctgccgaggatttcgatgccatcatagccgcacactttaagccaggagacactgttttggaaacggacatagcctcctttgataagagccaagatgattcacttgcgcttactgctttgatgctgttagaggatttaggggtggatcactccctgctggacttgatagaggctgctttcggagagatttccagctgtcacctaccgacaggtacgcgcttcaagttcggcgccatgatgaaatcaggtatgttcctaactctgttcgtcaacacattgttaaacatcaccatcgccagccgagtgctggaagatcgtctgacaaaatccgcgtgcgcggccttcatcggcgacgacaacataatacatggagtcgtctccgatgaattgatggcagccagatgtgccacttggatgaacatggaagtgaagatcatagatgcagttgtatccttgaaagccccttacttttgtggagggtttatactgcacgatactgtgacaggaacagcttgcagagtggcagacccgctaaaaaggctttttaaactgggcaaaccgctagcggcaggtgacgaacaagatgaagatagaagacgagcgctggctgacgaagtgatcagatggcaacgaacagggctaattgatgagctggagaaagcggtatactctaggtacgaagtgcagggtatatcagttgtggtaatgtccatggccacctttgcaagctccagatccaacttcgagaagctcagaggacccgtcataactttgtacggcggtcctaaataggtacgcactacagctacctattttgcagaagccgacagcaagtatctaaacactaatcagctacaatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaagtggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaacttgacaattaagtatgaaggtatatgtgtcccctaagagacacactgtacatagcaaataatctatagatcaaagggctacgcaacccctgaatagtaacaaaatacaaaatcactaaaaattataaaaacagaaaaatacataaataggtatacgtgtcccctaagagacacattgtatgtaggtgataagtatagatcaaagggccgaataacccctgaatagtaacaaaatatgaaaatcaataaaaatcataaaatagaaaaaccataaacagaagtagttcaaagggctataaaacccctgaatagtaacaaaacataaaattaataaaaatcaaatgaataccataattggcaaacggaagagatgtaggtacttaagcttcctaaaagcagccgaactcactttgagaagtaggcatagcataccgaactcttccacgattctccgaacccacagggacgtaggagatgttattttgtttttaatatttcaaaaaaaaaaaaaaaaaaaaaaaaaaaaaaaaaaaaaaaagcggccgcttaattaatcgaggggaattaattcttgaagacgaaagggccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcgagctcgtatggacatattgtcgttagaacgcggctacaattaatacataaccttatgtatcatacacaatcgatttaggtgacactatag

SEQ ID NO: 94 - DNA, 13826 bp, Artificial Sequence
  Synthetic polynucleotide
atggctgcgtgagacacacgtagcctaccagtttcttactgctctactctgcttagcaagagacttgagaacccatcatggatcccgtgtacgtggacatagacgccgacagcgcctttttaaaggccctgcagcgtgcgtaccccatgtttgaggtggaaccaaggcaggtcacaccgaatgaccatgccaatgctagagcattctcgcatctagctataaaactaatagagcaggaaattgatcccgactcaaccatcctggacataggcagcgcgccagcaaggaggatgatgtcggataggaagtaccactgcgtttgccctatgcgcagcgcagaagaccctgagagactcgccaactacgcgagaaaactagcatctgccgcaggaaaagtcttggacagaaacatctccgaaaaaattggagatctacaagcagtaatggctgtaccagacgcagaaacgcccacattctgcttgcacactgacgtctcatgtagacaaagggcggacgtcgctatataccaggatgtctacgccgtgcatgcaccaacatcgctgtaccaccaggcgattaaaggagtccgtgtagcatactggatagggtttgatacaaccccgttcatgtataatgccatggcaggtgcatacccctcgtactcgacaaactgggcagatgagcaggtgctgaaggcaaagaacataggattatgttcaacagacctgacggaaggtagacgaggtaaattgtctatcatgagaggaaaaaagatgaagccatgtgaccgcgtactgttctcagtcgggtcaacgctttacccggagagccgtaagcttcttaagagttggcacttaccttcagtgttccatctaaaagggaagctcagcttcacgtgccgctgtgatacagtggtttcgtgtgaaggctatgtcgttaagagaataacgattagcccgggcctctacggtaaaaccacagggtacgcagtaacccaccatgcagacggattcctaatgtgcaaaacaaccgatacggtagatggcgagagagtgtcattttcggtatgcacgtacgtacccgcaaccatttgtgatcaaatgacaggtattcttgccacggaggttacaccggaggatgcacagaagctgctggtgggactgaaccagaggatagtggtcaatggcagaacgcagaggaacacgaacacaatgaagaattacttgcttcctgtagttgcccaagccctcagtaagtgggcaaaggaatgccggaaagatatggaagatgaaaaacttttgggcatcagagaaaggacactgacatgctgctgcctttgggcgttcaagaagcagaagacacacacggtctacaagaggcctgacactcagtcaattcagaaagtcccagccgaatttgacagctttgtggtaccaagtctgtggtcatctggactgtcgatcccgctacggaccagaatcaagtggctgctaagcaaagtgccaaagactgatttgatcccttacagcggtgacgccaaagaagcccgcgacgctgaaaaagaagcagaagaagaacgagaagcggagctaactcgcgaggcactaccaccactacaggcggcacaggacgacgtccaggtcgaaattgacgtggaacagctcgaagacagagctggggcaggaataattgaaactccaagaggagctatcaaagtcactgcccaaccaacagaccacgtcgtgggagagtacttggtactttccccgcagaccgtgttacgaagccagaagctcagcctgatccacgcattggcggaacaagtgaagacatgcacacacagcggacgggcaggaaggtacgcggtcgaagcatatgacggcagaatccttgtgccctcaggctatgcaatatcacctgaagacttccagagcctgagcgaaagtgcgacgatggtgtacaacgaaagggagttcgtaaataggaaattacaccatatcgcgttgcacggaccagccctgaacactgacgaggagtcgtacgagctggtaagggcagaaaggacagagcatgagtacgtctatgatgtggaccaaagaaggtgctgcaagaaagaggaggcagccgggctggtactggtcggcgacttgaccaacccgccctaccatgagttcgcatatgaagggctgagaatccgccccgcctgcccatacaagaccgcagtaataggggtctttggagtgccaggatccggcaaatcagcaatcattaagaacctagttaccaggcaagacctagtgaccagtggaaagaaagaaaactgccaagaaatctccaccgacgtgatgcgacagaggaacctggagatatctgcacgcacggtcgactcactgctcttgaacggatgcaatagaccagtcgacgtgttgtacgtcgacgaagcttttgcgtgccattctggcacgctacttgctctgatagccttggtgagaccgaggcagaaagtcgtgctatgcggtgatccgaaacagtgcggcttcttcaatatgatgcagatgaaagttaactacaaccataacatctgcacccaagtgtaccataaaagtatttccaggcggtgtacactgcctgtgactgccattgtgtcctcgttgcattacgaaggcaaaatgcgcacaacaaatgagtacaacaagccaattgtagtggatactacaggctcgacaaaacccgaccccggagaccttgtgctaacatgtttcagagggtgggttaagcaactgcaaattgactatcgtggacacgaggtcatgacagcagctgcatctcaggggctaaccagaaaaggggtctatgccgtcaggcaaaaagttaatgaaaaccccctttacgcatcaacatcagagcacgtgaacgtgctactgacgcgtacggaaggcaaactagtatggaagacactttctggagacccatggataaagacactgcagaacccgccgaaaggaaattttaaagcaacaattaaggaatgggaagtggaacatgcttcaataatggcgggtatctgtaaccaccaagtgacctttgacacgttccagaataaagccaatgtctgctgggcgaagagcttagtccccatcctagaaacagcagggataaaattaaacgacaggcagtggtcccagataatccaggcttttaaagaagacagagcatactcacccgaggtggccctgaatgagatatgcacgcgcatgtacggggtagacctggacagcggactgttctctaaaccactggtgtccgtgcatcatgcggataatcactgggacaacaggccgggagggaagatgttcggattcaaccccgaagcggcgtccatactggagaggaaatacccgtttacaaaagggaagtggaataccaacaagcaaatctgtgtgactactaggaggattgaagattttaacccgaacaccaacattatacctgccaacaggagattaccgcattcattggtggccgaacatcgcccggtaaaaggggagaggatggaatggttggtcaacaaaataaatggccaccatgtgctcctggtcagcggctacaacctcgttctgcccactaagagagtcacctgggtggcgccgctgggcattcggggagctgactacacatacaacctagagttaggcctaccagcaacgctcggtagatatgacctagtgattataaacatccacacaccctttcgcatacatcattaccaacagtgcgtggatcacgcaatgaagctgcagatgctcggaggagactccctgagactgctcaagccgggtggttcattactgatcagggcatacggctacgcagacagaacaagcgaacgagtagtctgcgtattgggacgcaagtttcgatcatccagagcgttgaaaccgccgtgcgtcactagcaacaccgagatgtttttcttgttcagcaactttgataacggcagaaggaactttacgacgcacgtaatgaacaaccagctgaatgctgcttttgttggtcaggccacccgagcagggtgcgcaccgtcgtaccgggttaaacgcatggacatcgcaaagaacgatgaagagtgtgtagtcaacgccgccaaccctcgtgggctaccaggcgatggcgtctgtaaagcagtatacaaaaaatggccggagtccttcaagaacagtgcaacaccagtgggaaccgcaaagacagtcatgtgcggtacatacccggtaatccatgcagtaggacctaatttctcaaattactctgagtccgaaggagaccgggaattggcagctgcttaccgagaagtcgctaaggaggtgactagactaggagtaaacagcgtagctataccgctcctttccaccggtgtgtactctggagggaaagacaggctgactcagtcactaaaccacctttttacagcattagactcaactgatgcagatgtggttatctactgccgcgacaaggagtgggagaagaaaatagctgaggccatacaaatgaggacccaagtggaattactagacgaacacatctctgtagactgcgatatcatccgagtgcaccctgacagcagtttggcaggtagaaaagggtacagcactacagaaggttcactgtactcctacttggaagggacacggttccatcagacggcagtggacatggcagaagtatacaccatgtggccaaagcagacggaggctaatgaacaagtttgcttgtacgcattgggggaaagtatagaatcaatcaggcaaaagtgcccagtggatgacgcagatgcatcgtcgcccccaaaaaccgtcccgtgcctctgccgttatgccatgacacccgaacgagtcaccaggcttcgtatgaaccatgtcacaagcataatagtatgctcatcattcccccttccaaagtataaaatagaaggagtgcagaaagtcaagtgttctaaagtgatgctgttcgaccataacgtgccatcacgcgttagtccaagggaatataaatcgcctcaggagaccgcacaagaagtaagttcgaccacgtcactgacgcacagccaattcgaccttagcgttgacggtgaggaactgcccgctccgtctgacttggaagctgacgctccgattccggaaccaacaccagacgacagagcggtacttactttgcctcccacgattgataatttttcggctgtgtcagactgggtaatgaataccgcgccagtcgcaccacccagaagaagacgtgggaaaaacttgaatgtcacctgcgacgagagagaagggaacgtacttcccatggctagcgttcggttcttcagagcggatctgcactccatcgtacaggaaacggcagagatacgcgatacggccgcgtccctccaggcgcccctgagtgtcgctacagaaccgaatcaactgccgatctcatttggagcaccaaacgagactttccccataacgttcggggattttgatgaaggggagattgaaagcttgtcctctgagttactgacctttggggacttctcgccgggcgaagtggatgacctgacagacagcgactggtccacgtgttcagacacggacgacgaattatgactagatagggcaggtgggtacatattctcatctgacaccggccccggccacctgcaacagaggtctgtccgtcagacagtactgccggtaaataccttggaggaagttcaggaggagaaatgttacccacctaagttggatgaagtgaaagagcagttgttacttaagaaactccaggaaagtgcgtccatggctaacagaagcaggtaccaatcccgcaaagtagagaacatgaaagcaacaatagtccaaaggctgaagggtggttgcaaactttatttaatgtcggagaccccgaaagttcctacctaccgaactacatatccggcaccagtgtactcacccccaatcaatatccgactgtccaaccccgagtctgctgtggcagcgtgcaatgagttcctagcaaggaactatccgacagttgcgtcgtaccaaatcaccgatgagtacgatgcatacctagacatggtggacgggtcggaaagttgccttgaccgggcgacgttcaacccatcaaagcttagaagttatccaaaacagcactcctaccatgcacccacaatcagaagtgccgtaccttccccgttccagaacacgctgcagaacgtactggctgctgccacgaaaagaaattgcaacgtcacacagatgagagaactgcctactttggattcagcggtatttaatgttgagtgctttaaaaaatttgcgtgcaatcaagaatactggaaggaatttgccgccagccctattaggataacgactgagaacttgacaacttatgtcacaaaactaaaaggaccaaaagcagcagcactgtttgccaagacacataacctgctaccactgcaggaggtgccgatggacaggtttactgtagacatgaaaagggacgtgaaggtgactccggggacgaagcacactgaggaaagacctaaagtgcaggtcatacaggcagccgaacctttggcaacagcatatctgtgtgggatccacagagagttggtcagaaggctgaatgcagtccttctacctaatgtacacacgctgtttgacatgtctgccgaggactttgacgccattattgccgcgcacttcaagccgggggacgccgtattggaaaccgatatagcctcctttgacaagagccaagacgactcattggcgctcactgctctaatgttgctagaggatttgggggtggatcatcccctgttggacttgatagaggctgccttcggggagatctccagctgccacctaccgacgggcacccgttttaagttcggcgccatgatgaagtctggtatgttcctaaccctgttcgtcaacacactgctaaacatcaccatagccagccgagtgctggaggaccgcttgacaaggtctgcgtgcgcggccttcatcggcgacgacaatataatacatggggttgtctctgacgaactgatggcagcaaggtgtgctacatggatgaacatggaagtgaagatcatagatgcggtcgtgtctcagaaagccccgtacttctgcggagggtttatactgtatgacacagtagcaggcacggcctgcagagtggcagacccgctaaagcggctgttcaagctgggcaaaccgctggcagcgggagatgaacaagacgacgacagaagacgtgcactggctgacgaagtggttagatggcaacgaacaggactaactgatgagctagaaaaagcggtacactccaggtatgaagtgcagggcatatctgtcgtggtaatgtctatggccacctttgcaagctctagatctaactttgagaagctcagaggacccgtcgtaaccctgtacggtggtcctaaataggtacgcactacagctacctatttcgtcagaaaccaatcgcagctacttgcatacctaccagctacaatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaaaccgatgataaggcacgaaataactaaatagcaaaagtagaaagtacataaccaggtatatgtgccccttaagaggcacaatatatatagctaagcactattagatcaaagggctatacaacccctgaatagtaacaaaacacaaaaaccaataaaaatcataaaaagaaaaatctcataaacaggtataagtgtcccctaagagacacattgtatgtaggtagtaagtatagatcaaagggctatattaacccctgaatagtaacaaaacacaaaaacaataaaaactacaaaatagaaaatctataaacaaaagtagttcaaagggctacaaaacccctgaatagtaacaaaacataaaatgtaataaaaattaagtgtgtacccaaaagaggtacagtaagaatcagtgaatatcacaattggcaacgagaagagacgtaggtatttaagcttcctaaaagcagccgaactcactttgagacgtaggcatagcataccgaactcttccactattctccgaacccacagggacgtaggagatgttattttgtttttaatatttcaaaaaaaaaaaaaaaaaaaaaaaaaaaaaaaaaaaaaaaagcggccgcttaattaatcgaggggaattaattcttgaagacgaaagggccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcgagctcgtatggacatattgtcgttagaacgcggctacaattaatacataaccttatgtatcatacacaatcgatttaggtgacactatag

SEQ ID NO: 95 - DNA, 3744 bp, Chikungunya virus
atggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaattggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcac

SEQ ID NO: 96 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagcaccaaggacaacttcaatgtctataaagccacaagaccatacttagctcactgtcccgactgtggagaagggcactcgtgccatagtcccgtagcactagaacgcatcagaaatgaagcgacagacgggacgctgaaaatccaggtctccttgcaaatcggaataaagacggatgacagccacgattggaccaagctgcgttatatggacaaccacatgccagcagacgcagagagggcggggctatttgtaagaacatcagcaccgtgtacgattactggaacaatgggacacttcatcctggcccgatgtccaaaaggggaaactctgacggtgggattcactgacagtaggaagattagtcactcatgtacgcacccatttcaccacgaccctcctgtgataggtcgggaaaaattccattcccgaccgcagcacggtaaagagctaccttgcagcacgtacgtgcagagcaccgccgcaactaccgaggagatagaggtacacatgcccccagacacccctgatcgcacattaatgtcacaacagtccggcaacgtaaagatcacagtcaatggccagacggtgcggtacaagtgtaattgcggtggctcaaatgaaggactaacaactacagacaaagtgattaataactgcaaggttgatcaatgtcatgccgcggtcaccaatcacaaaaattggcagtataactcccctctggtcccgcgtaatgctgaacttggggaccgaaaaggaaaaattcacatcccgtttccgctggcaaatgtaacatgcagggtgcctaaagcaaggaaccccaccgtgacgtacgggaaaaaccaagtcatcatgctactgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 97 - protein, 1248 aa, Chikungunya virus
MEFIPTQTFYNRRYQPRPWTPRPTIQVIRPRPRPQRQAGQLAQLISAVNKLTMRAVPQQKPRRNRKNKKQKQKQQAPQNNTNQKKQPPKKKPAQKKKKPGRRERMCMKIENDCIFEVKHEGKVTGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLAIPVMCLLANTTFPCSQPPCTPCCYEKEPEETLRMLEDNVMRPGYYQLLQASLTCSPHRQRRSTKDNFNVYKATRPYLAHCPDCGEGHSCHSPVALERIRNEATDGTLKIQVSLQIGIKTDDSHDWTKLRYMDNHMPADAERAGLFVRTSAPCTITGTMGHFILARCPKGETLTVGFTDSRKISHSCTHPFHHDPPVIGREKFHSRPQHGKELPCSTYVQSTAATTEEIEVHMPPDTPDRTLMSQQSGNVKITVNGQTVRYKCNCGGSNEGLTTTDKVINNCKVDQCHAAVTNHKNWQYNSPLVPRNAELGDRKGKIHIPFPLANVTCRVPKARNPTVTYGKNQVIMLLYPDHPTLLSYRNMGEEPNYQEEWVMHKKEVVLTVPTEGLEVTWGNNEPYKYWPQLSTNGTAHGHPHEIILYYYELYPTMTVVVVSVATFILLSMVGMAAGMCMCARRRCITPYELTPGATVPFLLSLICCIRTAKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 98 - DNA, 3711 bp, Western equine encephalitis virus
atgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagtcaacttgactttcaaacaacgatcacctaatccgccgccaggtccaccgccaaagaagaagaagagtgctcctaagccaaaacctactcagcctaaaaagaagaagcagcaagccaagaggacgaaacgcaagcctaaaccagggaaacgacaacgtatgtgtatgaagttggagtcggacaagacatttccgatcatgctgaacggccaagtgaatggatatgcctgcgttgtcggaggaaggctgatgaaaccactccacgttgaaggaaaaattgataatgagcaattagcggccgtgaaattgaagaaggctagcatgtacgacttggagtacggcgacgttccccagaacatgaaatcagacacgctgcagtacaccagcgacaaaccaccgggcttctacaactggcaccacggcgcagtccagtatgagaatgggagatttaccgtaccgagaggagtgggcgggaaaggcgacagcggaagaccgatcctggacaacagaggcagagttgtggctattgttctaggaggtgcaaatgagggcacgcgtacggcgctttcagtggtcacttggaaccagaaaggggtgaccattagggatacccccgaaggttctgaaccgtggtcactagttacagcgctatgcgtgctttcgaatgtcacgttcccatgcgacaaaccacccgtgtgctattcactgacgccagaacgaacactcgacgtgctcgaagagaacgtcgacaatccaaattacgacacgctgctggagaacgtcttgaaatgtccatcacgccggcccaaacgaagcattaccgatgacttcacactgaccagtccctacctggggttctgcccgtattgcagacactcaacgccgtgtttcagcccaataaaaattgagaacgtgtgggacgaatctgatgatggatcgattagaatccaggtctcggcacaattcggctacaatcaggcaggcactgcggatgtcaccaaattccgttacatgtctttcgaccacgaccatgacatcaaggaagacagtatggagaaaatagctatcagcacatctggaccctgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacccgtccatggaaagctggtaaagtgccacgtttacgatcacttgaaggagacgtctgccgggtacataaccatgcacaggccaggcccacacgcgtataagtcctatctggaggaagcgtcaggcgaagtgtacattaaaccaccttctggcaagaacgtcacctacgaatgtaagtgtggcgactacagcacaggtatcgtgagcacgcgaacgaagatgaacggctgcactaaagcaaaacagtgcattgcctacaagagcgaccaaacgaattgggtcttcaactcgccggatcttattaggcacacagaccactcagtgcaaggtaaattgcacattccattccgcttgacaccgacagtctgcccggttccgttagctcacacgcctacagtcacgaagtggttcaaaggcatcaccctccacctgactgcaatgcgaccaacattgctgacaacgagaaaattggggctgcgagcagacgcaacagcagaatggattacagggtctacatccaggaatttttctgtggggcgagaagggctggagtacgtatggggtaaccatgaaccagtcagagtctgggcccaggagtcggcaccaggcgacccacatggatggccgcatgagatcatcatccactattatcatcggcatccagtctacactgtcattgtgctgtgtggtgtcgctcttgctatcctggtaggcactgcatcatcagcagcttgcatcgccaaagcaagaagagactgcctgacgccatacgcgcttgcaccgaacgcaacggtacccacagcattagcggttttgtgctgcattcggccaaccaacgctgaaacatttggagaaactttgaaccatctgtggtttaacaaccaaccgtttctctgggcacagttgtgcattcctctggcagcgcttgttattctgttccgctgcttttcatgctgcatgccttttttattggttgcaggcgtctgcctggggaaggtagacgccttcgaacatgcgaccactgtgccaaatgttccggggatcccgtataaggcgttggtcgaacgcgcaggttacgcgccacttaacctggagatcacggtcgtctcatcggaattaacaccttcaactaacaaggagtacgtgacctgcaaattccacacagtcattccttcaccacaagttaaatgctgcgggtccctcgagtgcaaggcatcctcaaaggcggattacacatgccgcgtttttggcggtgtgtaccctttcatgtggggaggcgcacaatgcttctgtgacagtgagaacacacaactgagtgaggcgtacgtcgagttcgctccagactgcactatagatcacgcagtcgcactaaaagttcacacagctgctctgaaagtcggcctgcgtatagtatacggcaacaccaccgcgcacctggatacgtttgtcaatggcgtcacgccaggttcctcacgggacctgaaggtcatagcagggccgatatcagccgctttttcaccctttgaccataaggtcgtcatcagaaaggggcttgtttacaactacgacttccctgagtatggagctatgaaaccaggagcgttcggcgatattcaagcatcctcgcttgatgctacagacatagtagcccgcactgacatacggctgctgaagccttctgtcaagaacatccacgtcccctacacccaagcagtatcagggtatgaaatgtggaagaacaactcaggacgacccctgcaagaaacagcaccatttggatgtaaaattgaagtggagcctctgcgagcgtctaactgtgcttacgggcacatccctatctcgattgacatccctgatgcagcttttgtgagatcatcagaatcaccaacaattttagaagttagctgcacagtagcagactgcatttattctgcagactttggtggttctctaacattacagtacaaagctgacagggagggacattgtccagttcactcccactccacgacagctgttttgaaggaagcgaccacacatgtgactgccgtaggcagcataacactacattttagcacatcgagcccacaagcaaattttatagtttcgctatgcggcaagaagtccacctgcaatgctgaatgtaaaccaccggccgaccacataattggagaaccacataaagtcgaccaagaattccaggcggcagtttccaaaacatcttggaactggctgcttgcactgtttgggggagcatcatccctcattgttgtaggacttatagtgttggtctgcagctctatgcttataaacacacgtagatga

SEQ ID NO: 99 - DNA, 8129 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagtcaacttgactttcaaacaacgatcacctaatccgccgccaggtccaccgccaaagaagaagaagagtgctcctaagccaaaacctactcagcctaaaaagaagaagcagcaagccaagaggacgaaacgcaagcctaaaccagggaaacgacaacgtatgtgtatgaagttggagtcggacaagacatttccgatcatgctgaacggccaagtgaatggatatgcctgcgttgtcggaggaaggctgatgaaaccactccacgttgaaggaaaaattgataatgagcaattagcggccgtgaaattgaagaaggctagcatgtacgacttggagtacggcgacgttccccagaacatgaaatcagacacgctgcagtacaccagcgacaaaccaccgggcttctacaactggcaccacggcgcagtccagtatgagaatgggagatttaccgtaccgagaggagtgggcgggaaaggcgacagcggaagaccgatcctggacaacagaggcagagttgtggctattgttctaggaggtgcaaatgagggcacgcgtacggcgctttcagtggtcacttggaaccagaaaggggtgaccattagggatacccccgaaggttctgaaccgtggtcactagttacagcgctatgcgtgctttcgaatgtcacgttcccatgcgacaaaccacccgtgtgctattcactgacgccagaacgaacactcgacgtgctcgaagagaacgtcgacaatccaaattacgacacgctgctggagaacgtcttgaaatgtccatcacgccggcccaaacgaagcattaccgatgacttcacactgaccagtccctacctggggttctgcccgtattgcagacactcaacgccgtgtttcagcccaataaaaattgagaacgtgtgggacgaatctgatgatggatcgattagaatccaggtctcggcacaattcggctacaatcaggcaggcactgcggatgtcaccaaattccgttacatgtctttcgaccacgaccatgacatcaaggaagacagtatggagaaaatagctatcagcacatctggaccctgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacccgtccatggaaagctggtaaagtgccacgtttacgatcacttgaaggagacgtctgccgggtacataaccatgcacaggccaggcccacacgcgtataagtcctatctggaggaagcgtcaggcgaagtgtacattaaaccaccttctggcaagaacgtcacctacgaatgtaagtgtggcgactacagcacaggtatcgtgagcacgcgaacgaagatgaacggctgcactaaagcaaaacagtgcattgcctacaagagcgaccaaacgaattgggtcttcaactcgccggatcttattaggcacacagaccactcagtgcaaggtaaattgcacattccattccgcttgacaccgacagtctgcccggttccgttagctcacacgcctacagtcacgaagtggttcaaaggcatcaccctccacctgactgcaatgcgaccaacattgctgacaacgagaaaattggggctgcgagcagacgcaacagcagaatggattacagggtctacatccaggaatttttctgtggggcgagaagggctggagtacgtatggggtaaccatgaaccagtcagagtctgggcccaggagtcggcaccaggcgacccacatggatggccgcatgagatcatcatccactattatcatcggcatccagtctacactgtcattgtgctgtgtggtgtcgctcttgctatcctggtaggcactgcatcatcagcagcttgcatcgccaaagcaagaagagactgcctgacgccatacgcgcttgcaccgaacgcaacggtacccacagcattagcggttttgtgctgcattcggccaaccaacgctgaaacatttggagaaactttgaaccatctgtggtttaacaaccaaccgtttctctgggcacagttgtgcattcctctggcagcgcttgttattctgttccgctgcttttcatgctgcatgccttttttattggttgcaggcgtctgcctggggaaggtagacgccttcgaacatgcgaccactgtgccaaatgttccggggatcccgtataaggcgttggtcgaacgcgcaggttacgcgccacttaacctggagatcacggtcgtctcatcggaattaacaccttcaactaacaaggagtacgtgacctgcaaattccacacagtcattccttcaccacaagttaaatgctgcgggtccctcgagtgcaaggcatcctcaaaggcggattacacatgccgcgtttttggcggtgtgtaccctttcatgtggggaggcgcacaatgcttctgtgacagtgagaacacacaactgagtgaggcgtacgtcgagttcgctccagactgcactatagatcacgcagtcgcactaaaagttcacacagctgctctgaaagtcggcctgcgtatagtatacggcaacaccaccgcgcacctggatacgtttgtcaatggcgtcacgccaggttcctcacgggacctgaaggtcatagcagggccgatatcagccgctttttcaccctttgaccataaggtcgtcatcagaaaggggcttgtttacaactacgacttccctgagtatggagctatgaaaccaggagcgttcggcgatattcaagcatcctcgcttgatgctacagacatagtagcccgcactgacatacggctgctgaagccttctgtcaagaacatccacgtcccctacacccaagcagtatcagggtatgaaatgtggaagaacaactcaggacgacccctgcaagaaacagcaccatttggatgtaaaattgaagtggagcctctgcgagcgtctaactgtgcttacgggcacatccctatctcgattgacatccctgatgcagcttttgtgagatcatcagaatcaccaacaattttagaagttagctgcacagtagcagactgcatttattctgcagactttggtggttctctaacattacagtacaaagctgacagggagggacattgtccagttcactcccactccacgacagctgttttgaaggaagcgaccacacatgtgactgccgtaggcagcataacactacattttagcacatcgagcccacaagcaaattttatagtttcgctatgcggcaagaagtccacctgcaatgctgaatgtaaaccaccggccgaccacataattggagaaccacataaagtcgaccaagaattccaggcggcagtttccaaaacatcttggaactggctgcttgcactgtttgggggagcatcatccctcattgttgtaggacttatagtgttggtctgcagctctatgcttataaacacacgtagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 100 - protein, 1236 aa, Western equine encephalitis virus
MFPYPQLNFPPVYPTNPMAYRDPNPPRRRWRPFRPPLAAQIEDLRRSIVNLTFKQRSPNPPPGPPPKKKKSAPKPKPTQPKKKKQQAKRTKRKPKPGKRQRMCMKLESDKTFPIMLNGQVNGYACVVGGRLMKPLHVEGKIDNEQLAAVKLKKASMYDLEYGDVPQNMKSDTLQYTSDKPPGFYNWHHGAVQYENGRFTVPRGVGGKGDSGRPILDNRGRVVAIVLGGANEGTRTALSVVTWNQKGVTIRDTPEGSEPWSLVTALCVLSNVTFPCDKPPVCYSLTPERTLDVLEENVDNPNYDTLLENVLKCPSRRPKRSITDDFTLTSPYLGFCPYCRHSTPCFSPIKIENVWDESDDGSIRIQVSAQFGYNQAGTADVTKFRYMSFDHDHDIKEDSMEKIAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKSDQTNWVFNSPDLIRHTDHSVQGKLHIPFRLTPTVCPVPLAHTPTVTKWFKGITLHLTAMRPTLLTTRKLGLRADATAEWITGSTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNAETFGETLNHLWFNNQPFLWAQLCIPLAALVILFRCFSCCMPFLLVAGVCLGKVDAFEHATTVPNVPGIPYKALVERAGYAPLNLEITVVSSELTPSTNKEYVTCKFHTVIPSPQVKCCGSLECKASSKADYTCRVFGGVYPFMWGGAQCFCDSENTQLSEAYVEFAPDCTIDHAVALKVHTAALKVGLRIVYGNTTAHLDTFVNGVTPGSSRDLKVIAGPISAAFSPFDHKVVIRKGLVYNYDFPEYGAMKPGAFGDIQASSLDATDIVARTDIRLLKPSVKNIHVPYTQAVSGYEMWKNNSGRPLQETAPFGCKIEVEPLRASNCAYGHIPISIDIPDAAFVRSSESPTILEVSCTVADCIYSADFGGSLTLQYKADREGHCPVHSHSTTAVLKEATTHVTAVGSITLHFSTSSPQANFIVSLCGKKSTCNAECKPPADHIIGEPHKVDQEFQAAVSKTSWNWLLALFGGASSLIVVGLIVLVCSSMLINTRR

SEQ ID NO: 101 - DNA, 3744 bp, Chikungunya virus
atggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcac

SEQ ID NO: 102 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 103 - protein, 1248 aa, Chikungunya virus
MEFIPTQTFYNRRYQPRPWAPRPTIQVIRPRPRPQRQAGQLAQLISAVNKLTMRAVPQQKPRRNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 104 - DNA, 3744 bp, Chikungunya virus
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcac

SEQ ID NO: 105 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 106 - protein, 1248 aa, Chikungunya virus
MEFIPTQTFYNRRYQPRPWAPRPTIQVIRPRPRPQRQAGQLAQLISAVNKLTMRAVPQQKPRRNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 107 - DNA, 3744 bp, Chikungunya virus; identical to SEQ ID NO: 101

SEQ ID NO: 108 - DNA, 8159 bp, Artificial Sequence; identical to SEQ ID NO: 102
  Synthetic polynucleotide

SEQ ID NO: 109 - protein, 1248 aa, Chikungunya virus
MEFIPTQTFYNRRYQPRPWTPRPTIQVIRPRPRPQRQAGQLAQLISAVNKLTMRAVPQQKPRRNRKNKKQKQKQQAPQNNTNQKKQPPKKKPAQKKKKPGRRERMCMKIENDCIFEVKHEGKVTGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLAIPVMCLLANTTFPCSQPPCTPCCYEKEPEETLRMLEDNVMRPGYYQLLQASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 110 - DNA, 3744 bp, Chikungunya virus
atggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcac

SEQ ID NO: 111 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccaacccaaactttttacaataggaggtaccagcctcgaccctggactccgcgccctactatccaagtcatcaggcccagaccgcgccctcagaggcaagctgggcaacttgcccagctgatctcagcagttaataaactgacaatgcgcgcggtaccacaacagaagccacgcaggaatcggaagaataagaagcaaaagcaaaaacaacaggcgccacaaaacaacacaaatcaaaagaagcagccacctaaaaagaaaccggctcaaaagaaaaagaagccgggccgcagagagaggatgtgcatgaaaatcgaaaatgattgtattttcgaagtcaagcacgaaggtaaggtaacaggttacgcgtgcctggtgggggacaaagtaatgaaaccagcacacgtaaaggggaccatcgataacgcggacctggccaaactggcctttaagcggtcatctaagtatgaccttgaatgcgcgcagatacccgtgcacatgaagtccgacgcttcgaagttcacccatgagaaaccggaggggtactacaactggcaccacggagcagtacagtactcaggaggccggttcaccatccctacaggtgctggcaaaccaggggacagcggcagaccgatcttcgacaacaagggacgcgtggtggccatagtcttaggaggagctaatgaaggagcccgtacagccctctcggtggtgacctggaataaagacattgtcactaaaatcacccccgagggggccgaagagtggagtcttgccatcccagttatgtgcctgttggcaaacaccacgttcccctgctcccagcccccttgcacgccctgctgctacgaaaaggaaccggaggaaaccctacgcatgcttgaggacaacgtcatgagacctgggtactatcagctgctacaagcatccttaacatgttctccccaccgccagcgacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccacccaacactcctgtcctaccggaatatgggagaagaaccaaactatcaagaagagtgggtgatgcataagaaggaagtcgtgctaaccgtgccgactgaagggctcgaggtcacgtggggcaacaacgagccgtataagtattggccgcagttatctacaaacggtacagcccatggccacccgcatgagataattctgtattattatgagctgtaccccactatgactgtagtagttgtgtcagtggccacgttcatactcctgtcgatggtgggtatggcagcggggatgtgcatgtgtgcacgacgcagatgcatcacaccgtatgaactgacaccaggagctaccgtccctttcctgcttagcctaatatgctgcatcagaacagctaaagcggccacataccaagaggctgcgatatacctgtggaacgagcagcaacctttgttttggctacaagcccttattccgctggcagccctgattgttctatgcaactgtctgagactcttaccatgctgctgtaaaacgttggcttttttagccgtaatgagcgtcggtgcccacactgtgagcgcgtacgaacacgtaacagtgatcccgaacacggtgggagtaccgtataagactctagtcaatagacctggctacagccccatggtattggagatggaactactgtcagtcactttggagccaacactatcgcttgattacatcacgtgcgagtacaaaaccgtcatcccgtctccgtacgtgaagtgctgcggtacagcagagtgcaaggacaaaaacctacctgactacagctgtaaggtcttcaccggcgtctacccatttatgtggggcggcgcctactgcttctgcgacgctgaaaacacgcagttgagcgaagcacacgtggagaagtccgaatcatgcaaaacagaatttgcatcagcatacagggctcataccgcatctgcatcagctaagctccgcgtcctttaccaaggaaataacatcactgtaactgcctatgcaaacggcgaccatgccgtcacagttaaggacgccaaattcattgtggggccaatgtcttcagcctggacacctttcgacaacaaaattgtggtgtacaaaggtgacgtctataacatggactacccgccctttggcgcaggaagaccaggacaatttggcgatatccaaagtcgcacacctgagagtaaagacgtctatgctaatacacaactggtactgcagagaccggctgtgggtacggtacacgtgccatactctcaggcaccatctggctttaagtattggctaaaagaacgcggggcgtcgctgcagcacacagcaccatttggctgccaaatagcaacaaacccggtaagagcggtgaactgcgccgtagggaacatgcccatctccatcgacataccggaagcggccttcactagggtcgtcgacgcgccctctttaacggacatgtcgtgcgaggtaccagcctgcacccattcctcagactttgggggcgtcgccattattaaatatgcagccagcaagaaaggcaagtgtgcggtgcattcgatgactaacgccgtcactattcgggaagctgagatagaagttgaagggaattctcagctgcaaatctctttctcgacggccttagccagcgccgaattccgcgtacaagtctgttctacacaagtacactgtgcagccgagtgccaccccccgaaggaccacatagtcaactacccggcgtcacataccaccctcggggtccaggacatctccgctacggcgatgtcatgggtgcagaagatcacgggaggtgtgggactggttgttgctgttgccgcactgattctaatcgtggtgctatgcgtgtcgttcagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 112 - protein, 1248 aa, Chikungunya virus
MEFIPTQTFYNRRYQPRPWTPRPTIQVIRPRPRPQRQAGQLAQLISAVNKLTMRAVPQQKPRRNRKNKKQKQKQQAPQNNTNQKKQPPKKKPAQKKKKPGRRERMCMKIENDCIFEVKHEGKVTGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLAIPVMCLLANTTFPCSQPPCTPCCYEKEPEETLRMLEDNVMRPGYYQLLQASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGEEPNYQEEWVMHKKEVVLTVPTEGLEVTWGNNEPYKYWPQLSTNGTAHGHPHEIILYYYELYPTMTVVVVSVATFILLSMVGMAAGMCMCARRRCITPYELTPGATVPFLLSLICCIRTAKAATYQEAAIYLWNEQQPLFWLQALIPLAALIVLCNCLRLLPCCCKTLAFLAVMSVGAHTVSAYEHVTVIPNTVGVPYKTLVNRPGYSPMVLEMELLSVTLEPTLSLDYITCEYKTVIPSPYVKCCGTAECKDKNLPDYSCKVFTGVYPFMWGGAYCFCDAENTQLSEAHVEKSESCKTEFASAYRAHTASASAKLRVLYQGNNITVTAYANGDHAVTVKDAKFIVGPMSSAWTPFDNKIVVYKGDVYNMDYPPFGAGRPGQFGDIQSRTPESKDVYANTQLVLQRPAVGTVHVPYSQAPSGFKYWLKERGASLQHTAPFGCQIATNPVRAVNCAVGNMPISIDIPEAAFTRVVDAPSLTDMSCEVPACTHSSDFGGVAIIKYAASKKGKCAVHSMTNAVTIREAEIEVEGNSQLQISFSTALASAEFRVQVCSTQVHCAAECHPPKDHIVNYPASHTTLGVQDISATAMSWVQKITGGVGLVVAVAALILIVVLCVSFSRH

SEQ ID NO: 113 - DNA, 777 bp, Western equine encephalitis virus
atgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataagaagaagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtgg

SEQ ID NO: 114 - DNA, 8129 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataagaagaagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtggtcactagttacagcgctgtgcgtgctttcgaatgtcacattcccttgcgacaaaccacccgtgtgctattcactggcgccagaacgaacactcgacgtgctcgaggagaacgtcgacaatccaaattacgacacgctgctggagaacgtcttgaaatgtccatcacgccggcccaaacgaagcattaccgatgacttcacgctgaccagtccctacctggggttctgcccgtattgcagacactcagcgccatgttttagcccaataaaaattgagaacgtgtgggacgaatctgatgatgggtcgattagaatccaggtctcggcacaattcggctacaatcaggcaggcactgcagacgtcaccaagttccggtacatgtcttacgaccacgaccatgacatcaaggaagacagtatggagaaattagctattagtacatccggaccatgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacctgtccatggaaagctggtaaagtgccacgtttacgatcacttgaaggagacgtctgccggatatataactatgcacaggccaggcccacacgcgtataagtcctacctggaggaagcgtcaggcgaagtgtacattaaaccaccttctggcaagaacgtcacctacgaatgtaagtgtggtgactacagcacaggtattgtgagcacgcgaacgaagatgaacggctgcactaaagcaaaacaatgcattgcctacaagcgcgaccaaacgaaatgggtcttcaactcgccggatcttattaggcacacagaccactcagtgcaaggtaaactgcacattccattccgcttgacaccgacagtctgcccggttccgttagctcacacgcctacagtcacgaagtggttcaaaggcatcaccctccacctgactgcaacgcgaccaacattgctgacaacgagaaaattggggctgcgagcagacgcaacagcagaatggattacggggactacatccaggaatttttctgtggggcgagaagggctggagtacgtatggggcaaccatgaaccagtcagagtctgggcccaggagtcggcaccaggcgacccgcatggatggccgcatgagatcatcatccattattatcatcggcatccagtctacactgtcattgtgctgtgcggtgtcgctctggctatcctggtaggcactgcatcgtcagcagcttgtatcgccaaagcaagaagagactgcctgacgccatacgcgcttgcaccgaacgcaacggtacccacagcattagcagttttgtgctgtattcggccaaccaacgctgaaacatttggagaaactttgaatcatctgtggtttaacaaccaaccgtttctctgggcacagttgtgcatccctctggcagcgcttattattctgttccgctgcttttcatgctgcatgccttttttattggttgcaggcgtctgcctggggaaggtagacgccttcgaacatgcgaccactgtgccaaatgttccggggatcccgtataaggcgttggtcgaacgtgcaggttacgcgccacttaatctggagattacggtcgtctcatcggaattaacaccctcaactaacaaggagtacgtgacctgcaaatttcacacagtcgttccttcaccacaagttaaatgctgcgggtccctcgagtgtaaggcatcctcaaaagcggattacacatgccgcgtttttggcggtgtgtaccctttcatgtggggaggcgcacagtgcttctgtgacagtgagaacacacaactgagtgaggcatacgtcgagttcgctccagactgcactatagatcatgcagtcgcactaaaagttcacacagctgctctgaaagtcggcctgcgtatagtatacggcaataccacagcgcgcctggatacattcgtcaacggcgtcacaccaggttcctcacgggacctgaaggtcatagcagggccgatatcagcagctttttcaccctttgaccataaggtcgtcattagaaaggggcttgtttacaactacgacttccctgagtatggagctatgaacccaggagcgttcggcgatattcaagcatcctctcttgatgccacagacatagtagcccgcaccgacatacggctgctgaagccttctgtcaagaacatccacgtcccctacacccaagcagtatcagggtatgaaatgtggaagaacaactcaggacgacccctgcaagaaacagcaccattcggatgtaaaattgaagtggagcctctgcgagcgactaactgtgcttatgggcacatccctatctcgattgacatccctgatgcagcttttgtgagatcatctgaatcaccaacaattttagaagtcagctgcacagtagcagactgcatttattctgcagactttggtggttcgctaacactacagtacaaagctaacagagagggacattgtccagttcactcccactccactacagctgttttgaaggaagcgaccacacatgtgactgccacaggcagcataacactacattttagcacatcgagcccacaagcaaatttcatagtttcgctatgcggcaagaagaccacctgcaatgctgaatgtaaaccaccggccgaccacataattggagaaccacataaggtcgaccaagaattccaggcggcagtttccaaaacatcttggaactggctgcttgcactgtttgggggagcatcatccctcattgttgtaggacttatagtgttggtctgcagctctatgcttataaacacacgtagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 115 - protein, 1236 aa, Western equine encephalitis virus
MFPYPQLNFPPVYPTNPMAYRDPNPPRRRWRPFRPPLAAQIEDLRRSIANLTFKQRAPNPPPGPPPNKKKSAPKPKPTQPKKKKQQAKKTKRKPKPGKRQRMCMKLESDKTFPIMLNGQVNGYACVVGGRLMKPLHVEGKIDNEQLAAVKLKKASMYDLEYGDVPQNMKSDTLQYTSDKPPGFYNWHHGAVQYENGRFTVPRGVGGKGDSGRPILDNRGRVVAIVLGGANEGTRTALSVVTWNQKGVTIKDTPEGSEPWSLVTALCVLSNVTFPCDKPPVCYSLAPERTLDVLEENVDNPNYDTLLENVLKCPSRRPKRSITDDFTLTSPYLGFCPYCRHSAPCFSPIKIENVWDESDDGSIRIQVSAQFGYNQAGTADVTKFRYMSYDHDHDIKEDSMEKLAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKRDQTKWVFNSPDLIRHTDHSVQGKLHIPFRLTPTVCPVPLAHTPTVTKWFKGITLHLTATRPTLLTTRKLGLRADATAEWITGTTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNAETFGETLNHLWFNNQPFLWAQLCIPLAALIILFRCFSCCMPFLLVAGVCLGKVDAFEHATTVPNVPGIPYKALVERAGYAPLNLEITVVSSELTPSTNKEYVTCKFHTVVPSPQVKCCGSLECKASSKADYTCRVFGGVYPFMWGGAQCFCDSENTQLSEAYVEFAPDCTIDHAVALKVHTAALKVGLRIVYGNTTARLDTFVNGVTPGSSRDLKVIAGPISAAFSPFDHKVVIRKGLVYNYDFPEYGAMNPGAFGDIQASSLDATDIVARTDIRLLKPSVKNIHVPYTQAVSGYEMWKNNSGRPLQETAPFGCKIEVEPLRATNCAYGHIPISIDIPDAAFVRSSESPTILEVSCTVADCIYSADFGGSLTLQYKANREGHCPVHSHSTTAVLKEATTHVTATGSITLHFSTSSPQANFIVSLCGKKTTCNAECKPPADHIIGEPHKVDQEFQAAVSKTSWNWLLALFGGASSLIVVGLIVLVCSSMLINTRR

SEQ ID NO: 116 - DNA, 777 bp, Western equine encephalitis virus
atgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataataagaagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtgg

SEQ ID NO: 117 - DNA, 8129 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataataagaagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtggtcactagttacagcgctgtgcgtgctttcgaatgtcacattcccttgcgacaaaccacccgtgtgctattcactggcgccagaacgaacactcgacgtgctcgaggagaacgtcgacaatccaaattacgacacgctgctggagaacgtcttgaaatgtccatcacgccggcccaaacgaagcattaccgatgacttcacgctgaccagtccctacctggggttctgcccgtattgcagacactcagcgccatgttttagcccaataaaaattgagaacgtgtgggacgaatctgatgatgggtcgattagaatccaggtctcggcacaattcggctacaatcaggcaggcactgcagacgtcaccaagttccggtacatgtcttacgaccacgaccatgacatcaaggaagacagtatggagaaattagctattagtacatccggaccatgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacctgtccatggaaagctggtaaagtgccacgtttacgatcacttgaaggagacgtctgccggatatataactatgcacaggccaggcccacacgcgtataagtcctacctggaggaagcgtcaggcgaagtgtacattaaaccaccttctggcaagaacgtcacctacgaatgtaagtgtggtgactacagcacaggtattgtgagcacgcgaacgaagatgaacggctgcactaaagcaaaacaatgcattgcctacaagcgcgaccaaacgaaatgggtcttcaactcgccggatcttattaggcacacagaccactcagtgcaaggtaaactgcacattccattccgcttgacaccgacagtctgcccggttccgttagctcacacgcctacagtcacgaagtggttcaaaggcatcaccctccacctgactgcaacgcgaccaacattgctgacaacgagaaaattggggctgcgagcagacgcaacagcagaatggattacggggactacatccaggaatttttctgtggggcgagaagggctggagtacgtatggggcaaccatgaaccagtcagagtctgggcccaggagtcggcaccaggcgacccgcatggatggccgcatgagatcatcatccattattatcatcggcatccagtctacactgtcattgtgctgtgcggtgtcgctctggctatcctggtaggcactgcatcgtcagcagcttgtatcgccaaagcaagaagagactgcctgacgccatacgcgcttgcaccgaacgcaacggtacccacagcattagcagttttgtgctgtattcggccaaccaacgctgaaacatttggagaaactttgaatcatctgtggtttaacaaccaaccgtttctctgggcacagttgtgcatccctctggcagcgcttattattctgttccgctgcttttcatgctgcatgccttttttattggttgcaggcgtctgcctggggaaggtagacgccttcgaacatgcgaccactgtgccaaatgttccggggatcccgtataaggcgttggtcgaacgtgcaggttacgcgccacttaatctggagattacggtcgtctcatcggaattaacaccctcaactaacaaggagtacgtgacctgcaaatttcacacagtcgttccttcaccacaagttaaatgctgcgggtccctcgagtgtaaggcatcctcaaaagcggattacacatgccgcgtttttggcggtgtgtaccctttcatgtggggaggcgcacagtgcttctgtgacagtgagaacacacaactgagtgaggcatacgtcgagttcgctccagactgcactatagatcatgcagtcgcactaaaagttcacacagctgctctgaaagtcggcctgcgtatagtatacggcaataccacagcgcgcctggatacattcgtcaacggcgtcacaccaggttcctcacgggacctgaaggtcatagcagggccgatatcagcagctttttcaccctttgaccataaggtcgtcattagaaaggggcttgtttacaactacgacttccctgagtatggagctatgaacccaggagcgttcggcgatattcaagcatcctctcttgatgccacagacatagtagcccgcaccgacatacggctgctgaagccttctgtcaagaacatccacgtcccctacacccaagcagtatcagggtatgaaatgtggaagaacaactcaggacgacccctgcaagaaacagcaccattcggatgtaaaattgaagtggagcctctgcgagcgactaactgtgcttatgggcacatccctatctcgattgacatccctgatgcagcttttgtgagatcatctgaatcaccaacaattttagaagtcagctgcacagtagcagactgcatttattctgcagactttggtggttcgctaacactacagtacaaagctaacagagagggacattgtccagttcactcccactccactacagctgttttgaaggaagcgaccacacatgtgactgccacaggcagcataacactacattttagcacatcgagcccacaagcaaatttcatagtttcgctatgcggcaagaagaccacctgcaatgctgaatgtaaaccaccggccgaccacataattggagaaccacataaggtcgaccaagaattccaggcggcagtttccaaaacatcttggaactggctgcttgcactgtttgggggagcatcatccctcattgttgtaggacttatagtgttggtctgcagctctatgcttataaacacacgtagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 118 - protein, 1236 aa, Western equine encephalitis virus
MFPYPQLNFPPVYPTNPMAYRDPNPPRRRWRPFRPPLAAQIEDLRRSIANLTFKQRAPNPPPGPPPNNKKSAPKPKPTQPKKKKQQAKKTKRKPKPGKRQRMCMKLESDKTFPIMLNGQVNGYACVVGGRLMKPLHVEGKIDNEQLAAVKLKKASMYDLEYGDVPQNMKSDTLQYTSDKPPGFYNWHHGAVQYENGRFTVPRGVGGKGDSGRPILDNRGRVVAIVLGGANEGTRTALSVVTWNQKGVTIKDTPEGSEPWSLVTALCVLSNVTFPCDKPPVCYSLAPERTLDVLEENVDNPNYDTLLENVLKCPSRRPKRSITDDFTLTSPYLGFCPYCRHSAPCFSPIKIENVWDESDDGSIRIQVSAQFGYNQAGTADVTKFRYMSYDHDHDIKEDSMEKLAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKRDQTKWVFNSPDLIRHTDHSVQGKLHIPFRLTPTVCPVPLAHTPTVTKWFKGITLHLTATRPTLLTTRKLGLRADATAEWITGTTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNAETFGETLNHLWFNNQPFLWAQLCIPLAALIILFRCFSCCMPFLLVAGVCLGKVDAFEHATTVPNVPGIPYKALVERAGYAPLNLEITVVSSELTPSTNKEYVTCKFHTVVPSPQVKCCGSLECKASSKADYTCRVFGGVYPFMWGGAQCFCDSENTQLSEAYVEFAPDCTIDHAVALKVHTAALKVGLRIVYGNTTARLDTFVNGVTPGSSRDLKVIAGPISAAFSPFDHKVVIRKGLVYNYDFPEYGAMNPGAFGDIQASSLDATDIVARTDIRLLKPSVKNIHVPYTQAVSGYEMWKNNSGRPLQETAPFGCKIEVEPLRATNCAYGHIPISIDIPDAAFVRSSESPTILEVSCTVADCIYSADFGGSLTLQYKANREGHCPVHSHSTTAVLKEATTHVTATGSITLHFSTSSPQANFIVSLCGKKTTCNAECKPPADHIIGEPHKVDQEFQAAVSKTSWNWLLALFGGASSLIVVGLIVLVCSSMLINTRR

SEQ ID NO: 119 - DNA, 777 bp, Western equine encephalitis virus
atgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataataataagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtgg

SEQ ID NO: 120 - DNA, 8129 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgtttccataccctcagctgaactttccaccagtttaccctacaaatccgatggcttaccgagatccaaaccctcctaggcgccgctggaggccgtttcggcccccgctggctgctcaaatcgaagatcttaggaggtcgatagccaacttaactttcaaacaacgagcacctaatccgccgccaggtccgccgccgaataataataagagtgctcccaaaccaaaacctactcagcctaaaaagaagaagcaacaagccaagaagacgaaacgcaagcctaaaccagggaaacgacagcgtatgtgtatgaagttggagtcggacaagacgtttccgatcatgttgaacggccaagtgaatggatacgcttgcgttgtcggaggaaggctgatgaaaccactccacgttgaaggaaaaatcgataatgagcaattagcggccgtgaaattgaagaaggctagcatgtacgacctggagtatggcgacgttccccagaatatgaaatcagacacgctgcagtacaccagcgacaaaccaccgggcttctacaactggcaccacggcgcagtccagtatgagaatgggagattcaccgtaccgcgaggagtgggcgggaaaggcgacagtggaagaccgatcctggacaacagaggcagagttgtggctattgttctaggaggtgcaaacgagggcacacgtacggcgctttcagtggtcacttggaaccagaaaggggtgaccatcaaggatacccccgaaggttctgaaccgtggtcactagttacagcgctgtgcgtgctttcgaatgtcacattcccttgcgacaaaccacccgtgtgctattcactggcgccagaacgaacactcgacgtgctcgaggagaacgtcgacaatccaaattacgacacgctgctggagaacgtcttgaaatgtccatcacgccggcccaaacgaagcattaccgatgacttcacgctgaccagtccctacctggggttctgcccgtattgcagacactcagcgccatgttttagcccaataaaaattgagaacgtgtgggacgaatctgatgatgggtcgattagaatccaggtctcggcacaattcggctacaatcaggcaggcactgcagacgtcaccaagttccggtacatgtcttacgaccacgaccatgacatcaaggaagacagtatggagaaattagctattagtacatccggaccatgccgtcgtcttggccacaaagggtacttcctgttagctcaatgtcctccaggtgacagtgtaaccgtcagtatcacgagcggagcatctgagaattcatgcaccgtggagaaaaagatcaggaggaagtttgtcggtagagaggagtacttgttcccacctgtccatggaaagctggtaaagtgccacgtttacgatcacttgaaggagacgtctgccggatatataactatgcacaggccaggcccacacgcgtataagtcctacctggaggaagcgtcaggcgaagtgtacattaaaccaccttctggcaagaacgtcacctacgaatgtaagtgtggtgactacagcacaggtattgtgagcacgcgaacgaagatgaacggctgcactaaagcaaaacaatgcattgcctacaagcgcgaccaaacgaaatgggtcttcaactcgccggatcttattaggcacacagaccactcagtgcaaggtaaactgcacattccattccgcttgacaccgacagtctgcccggttccgttagctcacacgcctacagtcacgaagtggttcaaaggcatcaccctccacctgactgcaacgcgaccaacattgctgacaacgagaaaattggggctgcgagcagacgcaacagcagaatggattacggggactacatccaggaatttttctgtggggcgagaagggctggagtacgtatggggcaaccatgaaccagtcagagtctgggcccaggagtcggcaccaggcgacccgcatggatggccgcatgagatcatcatccattattatcatcggcatccagtctacactgtcattgtgctgtgcggtgtcgctctggctatcctggtaggcactgcatcgtcagcagcttgtatcgccaaagcaagaagagactgcctgacgccatacgcgcttgcaccgaacgcaacggtacccacagcattagcagttttgtgctgtattcggccaaccaacgctgaaacatttggagaaactttgaatcatctgtggtttaacaaccaaccgtttctctgggcacagttgtgcatccctctggcagcgcttattattctgttccgctgcttttcatgctgcatgccttttttattggttgcaggcgtctgcctggggaaggtagacgccttcgaacatgcgaccactgtgccaaatgttccggggatcccgtataaggcgttggtcgaacgtgcaggttacgcgccacttaatctggagattacggtcgtctcatcggaattaacaccctcaactaacaaggagtacgtgacctgcaaatttcacacagtcgttccttcaccacaagttaaatgctgcgggtccctcgagtgtaaggcatcctcaaaagcggattacacatgccgcgtttttggcggtgtgtaccctttcatgtggggaggcgcacagtgcttctgtgacagtgagaacacacaactgagtgaggcatacgtcgagttcgctccagactgcactatagatcatgcagtcgcactaaaagttcacacagctgctctgaaagtcggcctgcgtatagtatacggcaataccacagcgcgcctggatacattcgtcaacggcgtcacaccaggttcctcacgggacctgaaggtcatagcagggccgatatcagcagctttttcaccctttgaccataaggtcgtcattagaaaggggcttgtttacaactacgacttccctgagtatggagctatgaacccaggagcgttcggcgatattcaagcatcctctcttgatgccacagacatagtagcccgcaccgacatacggctgctgaagccttctgtcaagaacatccacgtcccctacacccaagcagtatcagggtatgaaatgtggaagaacaactcaggacgacccctgcaagaaacagcaccattcggatgtaaaattgaagtggagcctctgcgagcgactaactgtgcttatgggcacatccctatctcgattgacatccctgatgcagcttttgtgagatcatctgaatcaccaacaattttagaagtcagctgcacagtagcagactgcatttattctgcagactttggtggttcgctaacactacagtacaaagctaacagagagggacattgtccagttcactcccactccactacagctgttttgaaggaagcgaccacacatgtgactgccacaggcagcataacactacattttagcacatcgagcccacaagcaaatttcatagtttcgctatgcggcaagaagaccacctgcaatgctgaatgtaaaccaccggccgaccacataattggagaaccacataaggtcgaccaagaattccaggcggcagtttccaaaacatcttggaactggctgcttgcactgtttgggggagcatcatccctcattgttgtaggacttatagtgttggtctgcagctctatgcttataaacacacgtagatgatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 121 - protein, 1236 aa, Western equine encephalitis virus
MFPYPQLNFPPVYPTNPMAYRDPNPPRRRWRPFRPPLAAQIEDLRRSIANLTFKQRAPNPPPGPPPNNNKSAPKPKPTQPKKKKQQAKKTKRKPKPGKRQRMCMKLESDKTFPIMLNGQVNGYACVVGGRLMKPLHVEGKIDNEQLAAVKLKKASMYDLEYGDVPQNMKSDTLQYTSDKPPGFYNWHHGAVQYENGRFTVPRGVGGKGDSGRPILDNRGRVVAIVLGGANEGTRTALSVVTWNQKGVTIKDTPEGSEPWSLVTALCVLSNVTFPCDKPPVCYSLAPERTLDVLEENVDNPNYDTLLENVLKCPSRRPKRSITDDFTLTSPYLGFCPYCRHSAPCFSPIKIENVWDESDDGSIRIQVSAQFGYNQAGTADVTKFRYMSYDHDHDIKEDSMEKLAISTSGPCRRLGHKGYFLLAQCPPGDSVTVSITSGASENSCTVEKKIRRKFVGREEYLFPPVHGKLVKCHVYDHLKETSAGYITMHRPGPHAYKSYLEEASGEVYIKPPSGKNVTYECKCGDYSTGIVSTRTKMNGCTKAKQCIAYKRDQTKWVFNSPDLIRHTDHSVQGKLHIPFRLTPTVCPVPLAHTPTVTKWFKGITLHLTATRPTLLTTRKLGLRADATAEWITGTTSRNFSVGREGLEYVWGNHEPVRVWAQESAPGDPHGWPHEIIIHYYHRHPVYTVIVLCGVALAILVGTASSAACIAKARRDCLTPYALAPNATVPTALAVLCCIRPTNAETFGETLNHLWFNNQPFLWAQLCIPLAALIILFRCFSCCMPFLLVAGVCLGKVDAFEHATTVPNVPGIPYKALVERAGYAPLNLEITVVSSELTPSTNKEYVTCKFHTVVPSPQVKCCGSLECKASSKADYTCRVFGGVYPFMWGGAQCFCDSENTQLSEAYVEFAPDCTIDHAVALKVHTAALKVGLRIVYGNTTARLDTFVNGVTPGSSRDLKVIAGPISAAFSPFDHKVVIRKGLVYNYDFPEYGAMNPGAFGDIQASSLDATDIVARTDIRLLKPSVKNIHVPYTQAVSGYEMWKNNSGRPLQETAPFGCKIEVEPLRATNCAYGHIPISIDIPDAAFVRSSESPTILEVSCTVADCIYSADFGGSLTLQYKANREGHCPVHSHSTTAVLKEATTHVTATGSITLHFSTSSPQANFIVSLCGKKTTCNAECKPPADHIIGEPHKVDQEFQAAVSKTSWNWLLALFGGASSLIVVGLIVLVCSSMLINTRR

SEQ ID NO: 122 - DNA, 3769 bp, Venezuelan equine encephalitis virus
atgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaataaaccgaagaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaag

SEQ ID NO: 123 - DNA, 8171 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaataaaccgaagaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 124 - protein, 1255 aa, Venezuelan equine encephalitis virus
MFPFQPMYPMQPMPYRNPFAAPRRPWFPRTDPFLAMQVQELTRSMANLTFKQRRDAPPEGPSANKPKKEASQKQKGGGQGKKKKNQGKKKAKTGPPNPKAQNGNKKKTNKKPGKRQRMVMKLESDKTFPIMLEGKINGYACVVGGKLFRPMHVEGKIDNDVLAALKTKKASKYDLEYADVPQNMRADTFKYTHEKPQGYYSWHHGAVQYENGRFTVPKGVGAKGDSGRPILDNQGRVVAIVLGGVNEGSRTALSVVMWNEKGVTVKYTPENCEQWSLVTTMCLLANVTFPCAQPPICYDRKPAETLAMLSVNVDNPGYDELLEAAVKCPGRKRRSTEELFNEYKLTRPYMARCIRCAVGSCHSPIAIEAVKSDGHDGYVRLQTSSQYGLDSSGNLKGRTMRYDMHGTIKEIPLHQVSLYTSRPCHIVDGHGYFLLARCPAGDSITMEFKKDSVRHSCSVPYEVKFNPVGRELYTHPPEHGVEQACQVYAHDAQNRGAYVEMHLPGSEVDSSLVSLSGSSVTVTPPDGTSALVECECGGTKISETINKTKQFSQCTKKEQCRAYRLQNDKWVYNSDKLPKAAGATLKGKLHVPFLLADGKCTVPLAPEPMITFGFRSVSLKLHPKNPTYLITRQLADEPHYTHELISEPAVRNFTVTEKGWEFVWGNHPPKRFWAQETAPGNPHGLPHEVITHYYHRYPMSTILGLSICAAIATVSVAASTWLFCRSRVACLTPYRLTPNARIPFCLAVLCCARTARAETTWESLDHLWNNNQQMFWIQLLIPLAALIVVTRLLRCVCCVVPFLVMAGAAGAGAYEHATTMPSQAGISYNTIVNRAGYAPLPISITPTKIKLIPTVNLEYVTCHYKTGMDSPAIKCCGSQECTPTYRPDEQCKVFTGVYPFMWGGAYCFCDTENTQVSKAYVMKSDDCLADHAEAYKAHTASVQAFLNITVGEHSIVTTVYVNGETPVNFNGVKITAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 125 - DNA, 3769 bp, Venezuelan equine encephalitis virus
atgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaataatccgaagaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaag

SEQ ID NO: 126 - DNA, 8171 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaataatccgaagaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 127 - protein, 1255 aa, Venezuelan equine encephalitis virus
MFPFQPMYPMQPMPYRNPFAAPRRPWFPRTDPFLAMQVQELTRSMANLTFKQRRDAPPEGPSANNPKKEASQKQKGGGQGKKKKNQGKKKAKTGPPNPKAQNGNKKKTNKKPGKRQRMVMKLESDKTFPIMLEGKINGYACVVGGKLFRPMHVEGKIDNDVLAALKTKKASKYDLEYADVPQNMRADTFKYTHEKPQGYYSWHHGAVQYENGRFTVPKGVGAKGDSGRPILDNQGRVVAIVLGGVNEGSRTALSVVMWNEKGVTVKYTPENCEQWSLVTTMCLLANVTFPCAQPPICYDRKPAETLAMLSVNVDNPGYDELLEAAVKCPGRKRRSTEELFNEYKLTRPYMARCIRCAVGSCHSPIAIEAVKSDGHDGYVRLQTSSQYGLDSSGNLKGRTMRYDMHGTIKEIPLHQVSLYTSRPCHIVDGHGYFLLARCPAGDSITMEFKKDSVRHSCSVPYEVKFNPVGRELYTHPPEHGVEQACQVYAHDAQNRGAYVEMHLPGSEVDSSLVSLSGSSVTVTPPDGTSALVECECGGTKISETINKTKQFSQCTKKEQCRAYRLQNDKWVYNSDKLPKAAGATLKGKLHVPFLLADGKCTVPLAPEPMITFGFRSVSLKLHPKNPTYLITRQLADEPHYTHELISEPAVRNFTVTEKGWEFVWGNHPPKRFWAQETAPGNPHGLPHEVITHYYHRYPMSTILGLSICAAIATVSVAASTWLFCRSRVACLTPYRLTPNARIPFCLAVLCCARTARAETTWESLDHLWNNNQQMFWIQLLIPLAALIVVTRLLRCVCCVVPFLVMAGAAGAGAYEHATTMPSQAGISYNTIVNRAGYAPLPISITPTKIKLIPTVNLEYVTCHYKTGMDSPAIKCCGSQECTPTYRPDEQCKVFTGVYPFMWGGAYCFCDTENTQVSKAYVMKSDDCLADHAEAYKAHTASVQAFLNITVGEHSIVTTVYVNGETPVNFNGVKITAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 128 - DNA, 3769 bp, Venezuelan equine encephalitis virus
atgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaagaatccgaataaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaag

SEQ ID NO: 129 - DNA, 8171 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaagaatccgaataaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 130 - protein, 1255 aa, Venezuelan equine encephalitis virus
MFPFQPMYPMQPMPYRNPFAAPRRPWFPRTDPFLAMQVQELTRSMANLTFKQRRDAPPEGPSAKNPNKEASQKQKGGGQGKKKKNQGKKKAKTGPPNPKAQNGNKKKTNKKPGKRQRMVMKLESDKTFPIMLEGKINGYACVVGGKLFRPMHVEGKIDNDVLAALKTKKASKYDLEYADVPQNMRADTFKYTHEKPQGYYSWHHGAVQYENGRFTVPKGVGAKGDSGRPILDNQGRVVAIVLGGVNEGSRTALSVVMWNEKGVTVKYTPENCEQWSLVTTMCLLANVTFPCAQPPICYDRKPAETLAMLSVNVDNPGYDELLEAAVKCPGRKRRSTEELFNEYKLTRPYMARCIRCAVGSCHSPIAIEAVKSDGHDGYVRLQTSSQYGLDSSGNLKGRTMRYDMHGTIKEIPLHQVSLYTSRPCHIVDGHGYFLLARCPAGDSITMEFKKDSVRHSCSVPYEVKFNPVGRELYTHPPEHGVEQACQVYAHDAQNRGAYVEMHLPGSEVDSSLVSLSGSSVTVTPPDGTSALVECECGGTKISETINKTKQFSQCTKKEQCRAYRLQNDKWVYNSDKLPKAAGATLKGKLHVPFLLADGKCTVPLAPEPMITFGFRSVSLKLHPKNPTYLITRQLADEPHYTHELISEPAVRNFTVTEKGWEFVWGNHPPKRFWAQETAPGNPHGLPHEVITHYYHRYPMSTILGLSICAAIATVSVAASTWLFCRSRVACLTPYRLTPNARIPFCLAVLCCARTARAETTWESLDHLWNNNQQMFWIQLLIPLAALIVVTRLLRCVCCVVPFLVMAGAAGAGAYEHATTMPSQAGISYNTIVNRAGYAPLPISITPTKIKLIPTVNLEYVTCHYKTGMDSPAIKCCGSQECTPTYRPDEQCKVFTGVYPFMWGGAYCFCDTENTQVSKAYVMKSDDCLADHAEAYKAHTASVQAFLNITVGEHSIVTTVYVNGETPVNFNGVKITAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 131 - DNA, 3769 bp, Venezuelan equine encephalitis virus
atgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaaggcaccggcgaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaag

SEQ ID NO: 132 - DNA, 8171 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccgttccagccaatgtatccgatgcagccaatgccctatcgcaacccgttcgcggccccgcgcaggccctggttccccagaaccgacccttttctggcgatgcaggtgcaggaattaacccgctcgatggctaacctgacgttcaagcaacgccgggacgcgccacctgaggggccatccgctaaggcaccggcgaaggaggcctcgcaaaaacagaaagggggaggccaagggaagaagaagaagaaccaagggaagaagaaggctaagacagggccgcctaatccgaaggcacagaatggaaacaagaagaagaccaacaagaaaccaggcaagagacagcgcatggtcatgaaattggaatctgacaagacgttcccaatcatgttggaagggaagataaacggctacgcttgtgtggtcggagggaagttattcaggccgatgcatgtggaaggcaagatcgacaacgacgttctggccgcgcttaagacgaagaaagcatccaaatacgatcttgagtatgcagatgtgccacagaacatgcgggccgatacattcaaatacacccatgagaaaccccaaggctattacagctggcatcatggagcagtccaatatgaaaatgggcgtttcacggtgccgaaaggagttggggccaagggagacagcggacgacccattctggataaccagggacgggtggtcgctattgtgctgggaggtgtgaatgaaggatctaggacagccctttcagtcgtcatgtggaacgagaagggagttaccgtgaagtatactccggagaactgcgagcaatggtcactagtgaccaccatgtgtctgctcgccaatgtgacgttcccatgtgctcaaccaccaatttgctacgacagaaaaccagcagagactttggccatgctcagcgttaacgttgacaacccgggctacgatgagctgctggaagcagctgttaagtgccccggaaggaaaaggagatccaccgaggagctgtttaatgagtataagctaacgcgcccttacatggccagatgcatcagatgtgcagttgggagctgccatagtccaatagcaatcgaggcagtaaagagcgacgggcacgacggttatgttagacttcagacttcctcgcagtatggcctggattcctccggcaacttaaagggcaggaccatgcggtatgacatgcacgggaccattaaagagataccactacatcaagtgtcactctatacatctcgcccgtgtcacattgtggatgggcacggttatttcctgcttgccaggtgcccggcaggggactccatcaccatggaatttaagaaagattccgtcagacactcctgctcggtgccgtatgaagtgaaatttaatcctgtaggcagagaactctatactcatcccccagaacacggagtagagcaagcgtgccaagtctacgcacatgatgcacagaacagaggagcttatgtcgagatgcacctcccgggctcagaagtggacagcagtttggtttccttgagcggcagttcagtcaccgtgacacctcctgatgggactagcgccctggtggaatgcgagtgtggcggcacaaagatctccgagaccatcaacaagacaaaacagttcagccagtgcacaaagaaggagcagtgcagagcatatcggctgcagaacgataagtgggtgtataattctgacaaactgcccaaagcagcgggagccaccttaaaaggaaaactgcatgtcccattcttgctggcagacggcaaatgcaccgtgcctctagcaccagaacctatgataaccttcggtttcagatcagtgtcactgaaactgcaccctaagaatcccacatatctaatcacccgccaacttgctgatgagcctcactacacgcacgagctcatatctgaaccagctgttaggaattttaccgtcaccgaaaaagggtgggagtttgtatggggaaaccacccgccgaaaaggttttgggcacaggaaacagcacccggaaatccacatgggctaccgcacgaggtgataactcattattaccacagataccctatgtccaccatcctgggtttgtcaatttgtgccgccattgcaaccgtttccgttgcagcgtctacctggctgttttgcagatctagagttgcgtgcctaactccttaccggctaacacctaacgctaggataccattttgtctggctgtgctttgctgcgcccgcactgcccgggccgagaccacctgggagtccttggatcacctatggaacaataaccaacagatgttctggattcaattgctgatccctctggccgccttgatcgtagtgactcgcctgctcaggtgcgtgtgctgtgtcgtgccttttttagtcatggccggcgccgcaggcgccggcgcctacgagcacgcgaccacgatgccgagccaagcgggaatctcgtataacactatagtcaacagagcaggctacgcaccactccctatcagcataacaccaacaaagatcaagctgatacctacagtgaacttggagtacgtcacctgccactacaaaacaggaatggattcaccagccatcaaatgctgcggatctcaggaatgcactccaacttacaggcctgatgaacagtgcaaagtcttcacaggggtttacccgttcatgtggggtggtgcatattgcttttgcgacactgagaacacccaagtcagcaaggcctacgtaatgaaatctgacgactgccttgcggatcatgctgaagcatataaagcgcacacagcctcagtgcaggcgttcctcaacatcacagtgggagaacactctattgtgactaccgtgtatgtgaatggagaaactcctgtgaatttcaatggggtcaaaataactgcaggtccgctttccacagcttggacaccctttgatcgcaaaatcgtgcagtatgccggggagatctataattatgattttcctgagtatggggcaggacaaccaggagcatttggagatatacaatccagaacagtctcaagctctgatctgtatgccaataccaacctagtgctgcagagacccaaagcaggagcgatccacgtgccatacactcaggcaccttcgggttttgagcaatggaagaaagataaagctccatcattgaaatttaccgcccctttcggatgcgaaatatatacaaaccccattcgcgccgaaaactgtgctgtagggtcaattccattagcctttgacattcccgacgccttgttcaccagggtgtcagaaacaccgacactttcagcggccgaatgcactcttaacgagtgcgtgtattcttccgactttggtgggatcgccacggtcaagtactcggccagcaagtcaggcaagtgcgcagtccatgtgccatcagggactgctaccctaaaagaagcagcagtcgagctaaccgagcaagggtcggcgactatccatttctcgaccgcaaatatccacccggagttcaggctccaaatatgcacatcatatgttacgtgcaaaggtgattgtcaccccccgaaagaccatattgtgacacaccctcagtatcacgcccaaacatttacagccgcggtgtcaaaaaccgcgtggacgtggttaacatccctgctgggaggatcagccgtaattattataattggcttggtgctggctactattgtggccatgtacgtgctgaccaaccagaaacataattaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 133 - protein, 1255 aa, Venezuelan equine encephalitis virus
MFPFQPMYPMQPMPYRNPFAAPRRPWFPRTDPFLAMQVQELTRSMANLTFKQRRDAPPEGPSAKAPAKEASQKQKGGGQGKKKKNQGKKKAKTGPPNPKAQNGNKKKTNKKPGKRQRMVMKLESDKTFPIMLEGKINGYACVVGGKLFRPMHVEGKIDNDVLAALKTKKASKYDLEYADVPQNMRADTFKYTHEKPQGYYSWHHGAVQYENGRFTVPKGVGAKGDSGRPILDNQGRVVAIVLGGVNEGSRTALSVVMWNEKGVTVKYTPENCEQWSLVTTMCLLANVTFPCAQPPICYDRKPAETLAMLSVNVDNPGYDELLEAAVKCPGRKRRSTEELFNEYKLTRPYMARCIRCAVGSCHSPIAIEAVKSDGHDGYVRLQTSSQYGLDSSGNLKGRTMRYDMHGTIKEIPLHQVSLYTSRPCHIVDGHGYFLLARCPAGDSITMEFKKDSVRHSCSVPYEVKFNPVGRELYTHPPEHGVEQACQVYAHDAQNRGAYVEMHLPGSEVDSSLVSLSGSSVTVTPPDGTSALVECECGGTKISETINKTKQFSQCTKKEQCRAYRLQNDKWVYNSDKLPKAAGATLKGKLHVPFLLADGKCTVPLAPEPMITFGFRSVSLKLHPKNPTYLITRQLADEPHYTHELISEPAVRNFTVTEKGWEFVWGNHPPKRFWAQETAPGNPHGLPHEVITHYYHRYPMSTILGLSICAAIATVSVAASTWLFCRSRVACLTPYRLTPNARIPFCLAVLCCARTARAETTWESLDHLWNNNQQMFWIQLLIPLAALIVVTRLLRCVCCVVPFLVMAGAAGAGAYEHATTMPSQAGISYNTIVNRAGYAPLPISITPTKIKLIPTVNLEYVTCHYKTGMDSPAIKCCGSQECTPTYRPDEQCKVFTGVYPFMWGGAYCFCDTENTQVSKAYVMKSDDCLADHAEAYKAHTASVQAFLNITVGEHSIVTTVYVNGETPVNFNGVKITAGPLSTAWTPFDRKIVQYAGEIYNYDFPEYGAGQPGAFGDIQSRTVSSSDLYANTNLVLQRPKAGAIHVPYTQAPSGFEQWKKDKAPSLKFTAPFGCEIYTNPIRAENCAVGSIPLAFDIPDALFTRVSETPTLSAAECTLNECVYSSDFGGIATVKYSASKSGKCAVHVPSGTATLKEAAVELTEQGSATIHFSTANIHPEFRLQICTSYVTCKGDCHPPKDHIVTHPQYHAQTFTAAVSKTAWTWLTSLLGGSAVIIIIGLVLATIVAMYVLTNQKHN

SEQ ID NO: 134 - DNA, 783 bp, Eastern equine encephalitis virus
atgttcccataccctacacttaactacccgcctatggcgccgatcaacccgatggcttaccgggatcctaatccgcctaggcgcaggtggcggccctttaggccaccacttgcagctcaaattgaggacctgagacgttccattgctagcctgactttgaaacaacgagcacctaatcctccagcaggaccgcccgccaatcgcaagaagcctgcgcccaagcctaagcctgcgcaggcgaaaaagaaacgaccaccaccacctgccaagaaacaaaaacgtaaacctaaaccaggcaaacgacagcgaatgtgtatgaagctagagtcagataaaacgtttccgatcatgttgaacggacaggtgaatggttacgcgtgcgtcgtgggtggacgagtgtttaaaccgctgcacgtagaaggcagaatagacaatgagcaactggccgccatcaagctgaagaaggccagcatatatgaccttgagtacggtgatgtgccacaatgcatgaaatcagataccctccagtacaccagtgacaagcctcctggcttttataactggcatcatggagctgtacagtatgagaacaataggttcaccgtaccacgaggggtcggtggaaagggtgacagcgggagacctattcttgacaacaaaggtagagtcgtcgcaattgtcctgggtggagtcaacgaaggatccaggacggctctatcagtggtgacatggaaccaaaaaggggttacagtcaaagatacaccagaggggtcagagccatgg

SEQ ID NO: 135 - DNA, 8147 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccataccctacacttaactacccgcctatggcgccgatcaacccgatggcttaccgggatcctaatccgcctaggcgcaggtggcggccctttaggccaccacttgcagctcaaattgaggacctgagacgttccattgctagcctgactttgaaacaacgagcacctaatcctccagcaggaccgcccgccaatcgcaagaagcctgcgcccaagcctaagcctgcgcaggcgaaaaagaaacgaccaccaccacctgccaagaaacaaaaacgtaaacctaaaccaggcaaacgacagcgaatgtgtatgaagctagagtcagataaaacgtttccgatcatgttgaacggacaggtgaatggttacgcgtgcgtcgtgggtggacgagtgtttaaaccgctgcacgtagaaggcagaatagacaatgagcaactggccgccatcaagctgaagaaggccagcatatatgaccttgagtacggtgatgtgccacaatgcatgaaatcagataccctccagtacaccagtgacaagcctcctggcttttataactggcatcatggagctgtacagtatgagaacaataggttcaccgtaccacgaggggtcggtggaaagggtgacagcgggagacctattcttgacaacaaaggtagagtcgtcgcaattgtcctgggtggagtcaacgaaggatccaggacggctctatcagtggtgacatggaaccaaaaaggggttacagtcaaagatacaccagaggggtcagagccatggtcgcttgccactgtcatgtgcgtcctggccaatatcacgtttccatgtgatcaaccaccctgcatgccatgctgttatgaaaagaatccacacgaaacactcaccatgttggaacagaattacgacagccgagcctatgatcagctgctcgatgccgctgtgaaatgtaatgctaggagaaccaggagagatttggacactcatttcacccagtataagctggcacgcccgtatattgctgattgccctaactgtgggcatagtcggtgcgacagccctatagctatagaagaagtcagaggggatgcgcatgcaggagtcatccgcatccagacatcagctatgttcggtctgaagacggatggagtcgatttggcctacatgagtttcatgaacggcaaaacgcagaaatcaataaagatcgacaacctgcatgtgcgcacctcagccccttgttccctcgtgtcgcaccacggctattacatcctggctcaatgcccaccaggagacacggttacagttgggtttcacgacgggcctaaccgccatacgtgcacagttgcccataaggtagaattcaggccagtgggtagagagaaataccgtcacccaccagaacatggagttgaattaccatgcaaccgttacactcacaagcgtgcagaccaaggacactacgttgagatgcatcaacccgggctagttgccgaccactctctccttagcatccacagtgccaaggtgaaaattacggtaccgagcggcgcccaggtgaaatactactgcaagtgcccagatgtacgaaagggaattaccagcagcgaccatacaaccacctgcacggatgtcaaacaatgcagggcttacctgattgacaacaaaaaatgggtgtacaactctggaagactgcctcgaggagagggcgacacttttaaaggaaaacttcatgtgccctttgtgcctgttaaggccaagtgcatcgccacgctggcaccagagcctctagttgagcacaaacaccgcaccctgattttacacctgcacccggaccatccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaatccacacggatggccgcacgaagtggtagtctattactacaacagatacccattaaccacaattatcgggttatgcacctgtgtggctatcatcatggtctcttgtgtcacatccgtgtggctcctttgcagaactcgcaatctttgcataaccccgtataaactagccccgaacgctcaagtcccaatactcctggcgttactttgctgcattaagccgacgagggcagatgacaccttgcaagtgctgaattacctgtggaacaacaatcaaaactttttctggatgcagacgcttatcccacttgcagcgcttatcgtatgcatgcgcatgctgcgctgcttattttgctgtgggccggcttttttacttgtctgcggcgccttgggcgccgcagcgtacgaacacacagcagtgatgccgaacaaggtggggatcccgtataaagctttagtcgaacgcccaggttacgcacccgttcacctacagatacagctggttaataccaggataattccatcaactaacctggagtacatcacctgcaagtataagacaaaagtgccttctccagtagtgaaatgctgcggtgccactcaatgtacctccaaaccccatcctgactatcagtgtcaggtgttttcaggtgtttacccattcatgtggggaggagcctactgcttctgcgacactgaaaacacccagatgagcgaggcgtatgtagagcgctcggaagagtgctctattgaccacgcaaaagcttataaagtacacacaggcactgttcaggcaatggtaaacataacttatgggagcgtcagctggagatctgcagatgtttacgtcaatggtgaaactcccgcgaaaataggagatgccaaactcatcataggtccactgtcatcagcgtggtccccattcgataacaaggtggtggtttatgggcatgaagtgtataattacgactttcctgagtacggcaccggcaaagcaggctcttttggagacctgcaatcacgcacatcaaccagcaacgatctgtacgcaaacaccaacttgaagctacaacgaccccaggctggtatcgtgcacacacctttcacccaggtgccctctggcttcgaacgatggaaaaaggacaaaggggcaccgttgaacgacgtagccccgtttggctgttcgattgccctggagccgctccgtgcagaaaattgtgcagtgggaagcatccctatatctatagatatacccgatgcggctttcaccagaatatctgaaacaccgacagtctcagacctggaatgcaaaattacggagtgtacttatgccttcgatttcggtggtatagccaccgttgcctacaaatccagtaaagcaggaaactgtccaattcattctccatcaggtgttgcagttattaaagagaatgacgtcacgcttgctgagagcggatcatttacattccacttctccactgcaaacatccatcctgcttttaagctgcaggtctgcactagtgcagttacctgcaaaggagattgtaagccaccgaaagaccacatcgtcgattatccagcacaacatactgaatcctttacgtcggcgatatccgccaccgcgtggtcgtggataaaagtgctggtaggaggaacatcagcatttatcgttctggggcttattgctacagcagtggttgccctagttctgttcttccatagacattaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 136 - protein, 1242 aa, Eastern equine encephalitis virus
MFPYPTLNYPPMAPINPMAYRDPNPPRRRWRPFRPPLAAQIEDLRRSIASLTLKQRAPNPPAGPPANRKKPAPKPKPAQAKKKRPPPPAKKQKRKPKPGKRQRMCMKLESDKTFPIMLNGQVNGYACVVGGRVFKPLHVEGRIDNEQLAAIKLKKASIYDLEYGDVPQCMKSDTLQYTSDKPPGFYNWHHGAVQYENNRFTVPRGVGGKGDSGRPILDNKGRVVAIVLGGVNEGSRTALSVVTWNQKGVTVKDTPEGSEPWSLATVMCVLANITFPCDQPPCMPCCYEKNPHETLTMLEQNYDSRAYDQLLDAAVKCNARRTRRDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVRKGITSSDHTTTCTDVKQCRAYLIDNKKWVYNSGRLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSVWLLCRTRNLCITPYKLAPNAQVPILLALLCCIKPTRADDTLQVLNYLWNNNQNFFWMQTLIPLAALIVCMRMLRCLFCCGPAFLLVCGALGAAAYEHTAVMPNKVGIPYKALVERPGYAPVHLQIQLVNTRIIPSTNLEYITCKYKTKVPSPVVKCCGATQCTSKPHPDYQCQVFSGVYPFMWGGAYCFCDTENTQMSEAYVERSEECSIDHAKAYKVHTGTVQAMVNITYGSVSWRSADVYVNGETPAKIGDAKLIIGPLSSAWSPFDNKVVVYGHEVYNYDFPEYGTGKAGSFGDLQSRTSTSNDLYANTNLKLQRPQAGIVHTPFTQVPSGFERWKKDKGAPLNDVAPFGCSIALEPLRAENCAVGSIPISIDIPDAAFTRISETPTVSDLECKITECTYAFDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWIKVLVGGTSAFIVLGLIATAVVALVLFFHRH

SEQ ID NO: 137 - DNA, 783 bp, Eastern equine encephalitis virus; identical to SEQ ID NO: 134

SEQ ID NO: 138 - DNA, 8147 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgccaccatgttcccataccctacacttaactacccgcctatggcgccgatcaacccgatggcttaccgggatcctaatccgcctaggcgcaggtggcggccctttaggccaccacttgcagctcaaattgaggacctgagacgttccattgctagcctgactttgaaacaacgagcacctaatcctccagcaggaccgcccgccaatcgcaagaagcctgcgcccaagcctaagcctgcgcaggcgaaaaagaaacgaccaccaccacctgccaagaaacaaaaacgtaaacctaaaccaggcaaacgacagcgaatgtgtatgaagctagagtcagataaaacgtttccgatcatgttgaacggacaggtgaatggttacgcgtgcgtcgtgggtggacgagtgtttaaaccgctgcacgtagaaggcagaatagacaatgagcaactggccgccatcaagctgaagaaggccagcatatatgaccttgagtacggtgatgtgccacaatgcatgaaatcagataccctccagtacaccagtgacaagcctcctggcttttataactggcatcatggagctgtacagtatgagaacaataggttcaccgtaccacgaggggtcggtggaaagggtgacagcgggagacctattcttgacaacaaaggtagagtcgtcgcaattgtcctgggtggagtcaacgaaggatccaggacggctctatcagtggtgacatggaaccaaaaaggggttacagtcaaagatacaccagaggggtcagagccatggtcgcttgccactgtcatgtgcgtcctggccaatatcacgtttccatgtgatcaaccaccctgcatgccatgctgttatgaaaagaatccacacgaaacactcaccatgttggaacagaattacgacagccgagcctatgatcagctgctcgatgccgctgtgaaatgtaatgctaggagaaccaggagagatttggacactcatttcacccagtataagctggcacgcccgtatattgctgattgccctaactgtgggcatagtcggtgcgacagccctatagctatagaagaagtcagaggggatgcgcatgcaggagtcatccgcatccagacatcagctatgttcggtctgaagacggatggagtcgatttggcctacatgagtttcatgaacggcaaaacgcagaaatcaataaagatcgacaacctgcatgtgcgcacctcagccccttgttccctcgtgtcgcaccacggctattacatcctggctcaatgcccaccaggagacacggttacagttgggtttcacgacgggcctaaccgccatacgtgcacagttgcccataaggtagaattcaggccagtgggtagagagaaataccgtcacccaccagaacatggagttgaattaccatgcaaccgttacactcacaagcgtgcagaccaaggacactacgttgagatgcatcaacccgggctagttgccgaccactctctccttagcatccacagtgccaaggtgaaaattacggtaccgagcggcgcccaggtgaaatactactgcaagtgcccagatgtacgaaagggaattaccagcagcgaccatacaaccacctgcacggatgtcaaacaatgcagggcttacctgattgacaacaaaaaatgggtgtacaactctggaaatctgcctcgaggagagggcgacacttttaaaggaaaacttcatgtgccctttgtgcctgttaaggccaagtgcatcgccacgctggcaccagagcctctagttgagcacaaacaccgcaccctgattttacacctgcacccggaccatccgaccttgctgacgaccaggtcacttggaagtgatgcaaatccaactcgacaatggattgagcgaccaacaactgtcaatttcacagtcaccggagaagggttggagtatacctggggaaaccatccaccaaaaagagtatgggctcaagagtcaggagaagggaatccacacggatggccgcacgaagtggtagtctattactacaacagatacccattaaccacaattatcgggttatgcacctgtgtggctatcatcatggtctcttgtgtcacatccgtgtggctcctttgcagaactcgcaatctttgcataaccccgtataaactagccccgaacgctcaagtcccaatactcctggcgttactttgctgcattaagccgacgagggcagatgacaccttgcaagtgctgaattacctgtggaacaacaatcaaaactttttctggatgcagacgcttatcccacttgcagcgcttatcgtatgcatgcgcatgctgcgctgcttattttgctgtgggccggcttttttacttgtctgcggcgccttgggcgccgcagcgtacgaacacacagcagtgatgccgaacaaggtggggatcccgtataaagctttagtcgaacgcccaggttacgcacccgttcacctacagatacagctggttaataccaggataattccatcaactaacctggagtacatcacctgcaagtataagacaaaagtgccttctccagtagtgaaatgctgcggtgccactcaatgtacctccaaaccccatcctgactatcagtgtcaggtgttttcaggtgtttacccattcatgtggggaggagcctactgcttctgcgacactgaaaacacccagatgagcgaggcgtatgtagagcgctcggaagagtgctctattgaccacgcaaaagcttataaagtacacacaggcactgttcaggcaatggtaaacataacttatgggagcgtcagctggagatctgcagatgtttacgtcaatggtgaaactcccgcgaaaataggagatgccaaactcatcataggtccactgtcatcagcgtggtccccattcgataacaaggtggtggtttatgggcatgaagtgtataattacgactttcctgagtacggcaccggcaaagcaggctcttttggagacctgcaatcacgcacatcaaccagcaacgatctgtacgcaaacaccaacttgaagctacaacgaccccaggctggtatcgtgcacacacctttcacccaggtgccctctggcttcgaacgatggaaaaaggacaaaggggcaccgttgaacgacgtagccccgtttggctgttcgattgccctggagccgctccgtgcagaaaattgtgcagtgggaagcatccctatatctatagatatacccgatgcggctttcaccagaatatctgaaacaccgacagtctcagacctggaatgcaaaattacggagtgtacttatgccttcgatttcggtggtatagccaccgttgcctacaaatccagtaaagcaggaaactgtccaattcattctccatcaggtgttgcagttattaaagagaatgacgtcacgcttgctgagagcggatcatttacattccacttctccactgcaaacatccatcctgcttttaagctgcaggtctgcactagtgcagttacctgcaaaggagattgtaagccaccgaaagaccacatcgtcgattatccagcacaacatactgaatcctttacgtcggcgatatccgccaccgcgtggtcgtggataaaagtgctggtaggaggaacatcagcatttatcgttctggggcttattgctacagcagtggttgccctagttctgttcttccatagacattaatctagaccaggccctggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 139 - protein, 1242 aa, Eastern equine encephalitis virus
MFPYPTLNYPPMAPINPMAYRDPNPPRRRWRPFRPPLAAQIEDLRRSIASLTLKQRAPNPPAGPPANRKKPAPKPKPAQAKKKRPPPPAKKQKRKPKPGKRQRMCMKLESDKTFPIMLNGQVNGYACVVGGRVFKPLHVEGRIDNEQLAAIKLKKASIYDLEYGDVPQCMKSDTLQYTSDKPPGFYNWHHGAVQYENNRFTVPRGVGGKGDSGRPILDNKGRVVAIVLGGVNEGSRTALSVVTWNQKGVTVKDTPEGSEPWSLATVMCVLANITFPCDQPPCMPCCYEKNPHETLTMLEQNYDSRAYDQLLDAAVKCNARRTRRDLDTHFTQYKLARPYIADCPNCGHSRCDSPIAIEEVRGDAHAGVIRIQTSAMFGLKTDGVDLAYMSFMNGKTQKSIKIDNLHVRTSAPCSLVSHHGYYILAQCPPGDTVTVGFHDGPNRHTCTVAHKVEFRPVGREKYRHPPEHGVELPCNRYTHKRADQGHYVEMHQPGLVADHSLLSIHSAKVKITVPSGAQVKYYCKCPDVRKGITSSDHTTTCTDVKQCRAYLIDNKKWVYNSGNLPRGEGDTFKGKLHVPFVPVKAKCIATLAPEPLVEHKHRTLILHLHPDHPTLLTTRSLGSDANPTRQWIERPTTVNFTVTGEGLEYTWGNHPPKRVWAQESGEGNPHGWPHEVVVYYYNRYPLTTIIGLCTCVAIIMVSCVTSVWLLCRTRNLCITPYKLAPNAQVPILLALLCCIKPTRADDTLQVLNYLWNNNQNFFWMQTLIPLAALIVCMRMLRCLFCCGPAFLLVCGALGAAAYEHTAVMPNKVGIPYKALVERPGYAPVHLQIQLVNTRIIPSTNLEYITCKYKTKVPSPVVKCCGATQCTSKPHPDYQCQVFSGVYPFMWGGAYCFCDTENTQMSEAYVERSEECSIDHAKAYKVHTGTVQAMVNITYGSVSWRSADVYVNGETPAKIGDAKLIIGPLSSAWSPFDNKVVVYGHEVYNYDFPEYGTGKAGSFGDLQSRTSTSNDLYANTNLKLQRPQAGIVHTPFTQVPSGFERWKKDKGAPLNDVAPFGCSIALEPLRAENCAVGSIPISIDIPDAAFTRISETPTVSDLECKITECTYAFDFGGIATVAYKSSKAGNCPIHSPSGVAVIKENDVTLAESGSFTFHFSTANIHPAFKLQVCTSAVTCKGDCKPPKDHIVDYPAQHTESFTSAISATAWSWIKVLVGGTSAFIVLGLIATAVVALVLFFHRH

SEQ ID NO: 140 - DNA, 3747 bp, Chikungunya virus
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaa

SEQ ID NO: 141 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccagaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 142 - protein, 1248 aa, Chikungunya virus
MEFIPTQTFYNRRYQPRPWAPRPTIQVIRPRPRPQRQAGQLAQLISAVNKLTMRAVPQQKPARNRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 143 - DNA, 3747 bp, Chikungunya virus
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccgcaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaa

SEQ ID NO: 144 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccgcaaatcggaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 145 - protein, 1248 aa, Chikungunya virus
MEFIPTQTFYNRRYQPRPWAPRPTIQVIRPRPRPQRQAGQLAQLISAVNKLTMRAVPQQKPAANRKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 146 - DNA, 3747 bp, Chikungunya virus
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccgcaaatgcggcaaacgcggcgcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaa

SEQ ID NO: 147 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctgccgcaaatgcggcaaacgcggcgcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 148 - protein, 1248 aa, Chikungunya virus
MEFIPTQTFYNRRYQPRPWAPRPTIQVIRPRPRPQRQAGQLAQLISAVNKLTMRAVPQQKPAANAANAAQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 149 - DNA, 3747 bp, Chikungunya virus
atggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatgcgaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaa

SEQ ID NO: 150 - DNA, 8159 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatggagttcatcccgacgcaaactttctataacagaaggtaccaaccccgaccctgggccccacgccctacaattcaagtaattagacctagaccacgtccacagaggcaggctgggcaactcgcccagctgatctccgcagtcaacaaattgaccatgcgcgcggtacctcaacagaagcctcgcagaaatgcgaaaaacaagaagcaaaggcagaagaagcaggcgccgcaaaacgacccaaagcaaaagaagcaaccaccacaaaagaagccggctcaaaagaagaagaaaccaggccgtagggagagaatgtgcatgaaaattgaaaatgattgcatcttcgaagtcaagcatgaaggcaaagtgatgggctacgcatgcctggtgggggataaagtaatgaaaccagcacatgtgaagggaactatcgacaatgccgatctggctaaactggcctttaagcggtcgtctaaatacgatcttgaatgtgcacagataccggtgcacatgaagtctgatgcctcgaagtttacccacgagaaacccgaggggtactataactggcatcacggagcagtgcagtattcaggaggccggttcactatcccgacgggtgcaggcaagccgggagacagcggcagaccgatcttcgacaacaaaggacgggtggtggccatcgtcctaggaggggccaacgaaggtgcccgcacggccctctccgtggtgacgtggaacaaagacatcgtcacaaaaattacccctgagggagccgaagagtggagcctcgccctcccggtcttgtgcctgttggcaaacactacattcccctgctctcagccgccttgcacaccctgctgctacgaaaaggaaccggaaagcaccttgcgcatgcttgaggacaacgtgatgagacccggatactaccagctactaaaagcatcgctgacttgctctccccaccgccaaagacgcagtactaaggacaattttaatgtctataaagccacaagaccatatctagctcattgtcctgactgcggagaagggcattcgtgccacagccctatcgcattggagcgcatcagaaatgaagcaacggacggaacgctgaaaatccaggtctctttgcagatcgggataaagacagatgacagccacgattggaccaagctgcgctatatggatagccatacgccagcggacgcggagcgagccggattgcttgtaaggacttcagcaccgtgcacgatcaccgggaccatgggacactttattctcgcccgatgcccgaaaggagagacgctgacagtgggatttacggacagcagaaagatcagccacacatgcacacacccgttccatcatgaaccacctgtgataggtagggagaggttccactctcgaccacaacatggtaaagagttaccttgcagcacgtacgtgcagagcaccgctgccactgctgaggagatagaggtgcatatgcccccagatactcctgaccgcacgctgatgacgcagcagtctggcaacgtgaagatcacagttaatgggcagacggtgcggtacaagtgcaactgcggtggctcaaacgagggactgacaaccacagacaaagtgatcaataactgcaaaattgatcagtgccatgctgcagtcactaatcacaagaattggcaatacaactcccctttagtcccgcgcaacgctgaactcggggaccgtaaaggaaagatccacatcccattcccattggcaaacgtgacttgcagagtgccaaaagcaagaaaccctacagtaacttacggaaaaaaccaagtcaccatgctgctgtatcctgaccatccgacactcttgtcttaccgtaacatgggacaggaaccaaattaccacgaggagtgggtgacacacaagaaggaggttaccttgaccgtgcctactgagggtctggaggtcacttggggcaacaacgaaccatacaagtactggccgcagatgtctacgaacggtactgctcatggtcacccacatgagataatcttgtactattatgagctgtaccccactatgactgtagtcattgtgtcggtggcctcgttcgtgcttctgtcgatggtgggcacagcagtgggaatgtgtgtgtgcgcacggcgcagatgcattacaccatatgaattaacaccaggagccactgttcccttcctgctcagcctgctatgctgcgtcagaacgaccaaggcggccacatattacgaggctgcggcatatctatggaacgaacagcagcccctgttctggttgcaggctcttatcccgctggccgccttgatcgtcctgtgcaactgtctgaaactcttgccatgctgctgtaagaccctggcttttttagccgtaatgagcatcggtgcccacactgtgagcgcgtacgaacacgtaacagtgatcccgaacacggtgggagtaccgtataagactcttgtcaacagaccgggttacagccccatggtgttggagatggagctacaatcagtcaccttggaaccaacactgtcacttgactacatcacgtgcgagtacaaaactgtcatcccctccccgtacgtgaagtgctgtggtacagcagagtgcaaggacaagagcctaccagactacagctgcaaggtctttactggagtctacccatttatgtggggcggcgcctactgcttttgcgacgccgaaaatacgcaattgagcgaggcacatgtagagaaatctgaatcttgcaaaacagagtttgcatcggcctacagagcccacaccgcatcggcgtcggcgaagctccgcgtcctttaccaaggaaacaacattaccgtagctgcctacgctaacggtgaccatgccgtcacagtaaaggacgccaagtttgtcgtgggcccaatgtcctccgcctggacaccttttgacaacaaaatcgtggtgtacaaaggcgacgtctacaacatggactacccaccttttggcgcaggaagaccaggacaatttggtgacattcaaagtcgtacaccggaaagtaaagacgtttatgccaacactcagttggtactacagaggccagcagcaggcacggtacatgtaccatactctcaggcaccatctggcttcaagtattggctgaaggaacgaggagcatcgctacagcacacggcaccgttcggttgccagattgcgacaaacccggtaagagctgtaaattgcgctgtggggaacataccaatttccatcgacataccggatgcggcctttactagggttgtcgatgcaccctctgtaacggacatgtcatgcgaagtaccagcctgcactcactcctccgactttgggggcgtcgccatcatcaaatacacagctagcaagaaaggtaaatgtgcagtacattcgatgaccaacgccgttaccattcgagaagccgacgtagaagtagaggggaactcccagctgcaaatatccttctcaacagccctggcaagcgccgagtttcgcgtgcaagtgtgctccacacaagtacactgcgcagccgcatgccaccctccaaaggaccacatagtcaattacccagcatcacacaccacccttggggtccaggatatatccacaacggcaatgtcttgggtgcagaagattacgggaggagtaggattaattgttgctgttgctgccttaattttaattgtggtgctatgcgtgtcgtttagcaggcactaatgaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 151 - protein, 1247 aa, Chikungunya virus
EFIPTQTFYNRRYQPRPWAPRPTIQVIRPRPRPQRQAGQLAQLISAVNKLTMRAVPQQKPRRNAKNKKQRQKKQAPQNDPKQKKQPPQKKPAQKKKKPGRRERMCMKIENDCIFEVKHEGKVMGYACLVGDKVMKPAHVKGTIDNADLAKLAFKRSSKYDLECAQIPVHMKSDASKFTHEKPEGYYNWHHGAVQYSGGRFTIPTGAGKPGDSGRPIFDNKGRVVAIVLGGANEGARTALSVVTWNKDIVTKITPEGAEEWSLALPVLCLLANTTFPCSQPPCTPCCYEKEPESTLRMLEDNVMRPGYYQLLKASLTCSPHRQRRSTKDNFNVYKATRPYLAHCPDCGEGHSCHSPIALERIRNEATDGTLKIQVSLQIGIKTDDSHDWTKLRYMDSHTPADAERAGLLVRTSAPCTITGTMGHFILARCPKGETLTVGFTDSRKISHTCTHPFHHEPPVIGRERFHSRPQHGKELPCSTYVQSTAATAEEIEVHMPPDTPDRTLMTQQSGNVKITVNGQTVRYKCNCGGSNEGLTTTDKVINNCKIDQCHAAVTNHKNWQYNSPLVPRNAELGDRKGKIHIPFPLANVTCRVPKARNPTVTYGKNQVTMLLYPDHPTLLSYRNMGQEPNYHEEWVTHKKEVTLTVPTEGLEVTWGNNEPYKYWPQMSTNGTAHGHPHEIILYYYELYPTMTVVIVSVASFVLLSMVGTAVGMCVCARRRCITPYELTPGATVPFLLSLLCCVRTTKAATYYEAAAYLWNEQQPLFWLQALIPLAALIVLCNCLKLLPCCCKTLAFLAVMSIGAHTVSAYEHVTVIPNTVGVPYKTLVNRPGYSPMVLEMELQSVTLEPTLSLDYITCEYKTVIPSPYVKCCGTAECKDKSLPDYSCKVFTGVYPFMWGGAYCFCDAENTQLSEAHVEKSESCKTEFASAYRAHTASASAKLRVLYQGNNITVAAYANGDHAVTVKDAKFVVGPMSSAWTPFDNKIVVYKGDVYNMDYPPFGAGRPGQFGDIQSRTPESKDVYANTQLVLQRPAAGTVHVPYSQAPSGFKYWLKERGASLQHTAPFGCQIATNPVRAVNCAVGNIPISIDIPDAAFTRVVDAPSVTDMSCEVPACTHSSDFGGVAIIKYTASKKGKCAVHSMTNAVTIREADVEVEGNSQLQISFSTALASAEFRVQVCSTQVHCAAACHPPKDHIVNYPASHTTLGVQDISTTAMSWVQKITGGVGLIVAVAALILIVVLCVSFSRH

SEQ ID NO: 152 - DNA, 810 bp, Ross river virus
atgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataagaagaaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtgg

SEQ ID NO: 153 - DNA, 8174 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataagaagaaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtggtctgccgcgctgatgatgtgtatccttgccaacacctctttcccctgctcatcacctccctgctacccctgctgctacgaaaaacagccagaacagacactgcggatgctggaagacaatgtgaatagaccagggtactatgagctactggaagcgtccatgacatgcagaaacagatcacgccaccgccgtagtgtaacagagcacttcaatgtgtataaggctactagaccgtacttagcgtattgcgctgactgtggggacgggtacttctgctatagcccagttgctatcgagaagatccgagatgaggcgtctgacggcatgctcaagatccaagtctccgcccaaataggtctggacaaggcaggtacccacgcccacacgaagatccgatatatggctggtcatgatgttcaggaatctaagagagattccttgagggtgtacacgtccgcagcgtgctctatacatgggacgatgggacacttcatcgtcgcacattgtccgccaggcgactacctcaaggtttcgttcgaggacgcagattcacacgtgaaggcatgtaaggtccaatacaagcacgacccattgccggtgggtagagagaagttcgtggttagaccccactttggcgtagagctgccatgcacctcataccagctgacaacagctcccaccgacgaggagatcgacatgcacacaccgccagatataccggatcgcaccctgctatcacagacggcgggcaacgtcaaaataacagcaggcggcaggactatcaggtacaattgtacctgtggccgtgacaacgtaggcactaccagtactgacaagaccatcaacacatgcaagattgaccaatgccatgctgccgttaccagccatgacaaatggcaatttacctctccatttgttcccagggctgatcagacagctaggaggggcaaagtgcatgttccattccctttgactaacgtcacctgccgagtgccgttggctcgagcgccggatgtcacctatggtaagaaggaggtgaccctgagattacacccagatcatccgacgctcttctcctataggagtttaggagccgaaccgcacccgtacgaggagtgggttgacaagttctctgagcgcatcatcccagtgacggaagaagggattgagtaccagtggggcaacaacccgccggtccgcctatgggcgcaactgacgaccgagggcaaaccccatggctggccacatgaaatcattcagtactattatggactataccccgccgccaccattgccgcagtatccggggcgagtctgatggccctcctaactctagcggccacatgctgcatgctggccaccgcgaggagaaagtgcctaacaccatacgccttgacgccaggagcggtggtaccgttgacactggggctgctttgctgcgcaccgagggcgaacgcagcatcattcgctgagactatggcatatctgtgggacgagaacaaaaccctcttttggatggaattcgcggccccagccgcagcgcttgctttgctggcatgctgtatcaaaagcctgatctgctgttgtaagccattttcttttttagtgttactgagcctgggagcctccgcaaaagcttacgagcacacagccacaattccgaatgtggtggggttcccgtataaggctcacattgaaaggaatggcttctcgcccatgactctgcagcttgaagtggtggagacaagcttggaacccacacttaacctggagtacattacctgcgaatacaagacggtggtcccttcgccattcatcaaatgttgcggaacatcagaatgctcatccaaggagcagccagactaccaatgcaaggtgtacacgggtgtatacccattcatgtggggtggagcctactgtttctgcgactccgagaacacgcagctcagcgaggcctatgtcgacaggtcagacgtttgcaaacatgatcacgcatcggcctacaaggcacacacggcctctctaaaagcaacaatcaggatcagttatggcaccatcaaccagaccaccgaggccttcgttaatggtgaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggtagattcggagacattcagagcaggacagtggagagcaaagacttgtatgccaacacggccctaaaactctcaagaccatcacccggggttgtgcatgtgccatacacgcagacaccatccggatttaaatattggctgaaggagaaaggatcttcattgaatacaaaggccccttttggctgcaagataaagaccaatccagtcagagccatggattgtgcagttggcagtatacctgtgtcgatggacatacctgacagtgcattcacacgagtggtagatgccccggctgtaacagacctgagctgccaggtagtggtctgtacacactcctccgatttcggaggagttgccacattgtcttacaaaacggacaaacccggcaagtgcgctgtccactcacattccaacgtcgcaacgttgcaagaggcgacggtggatgtcaaggaggatggcaaggtcacagtgcacttttccacggcgtccgcctccccggccttcaaagtgtccgtctgtgacgcaaaaacaacgtgcacggcggcgtgcgagcctccaaaagaccacatcgtcccttatggggcgagccataacaaccaggtctttccggacatgtcaggaactgcgatgacgtgggtgcagaggctggccagtgggttaggtgggctggctctcatcgcggtggttgtgctggtcttggtaacctgcataacaatgcgtcggtaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 154 - protein, 1254 aa, Ross river virus
MNYIPTQTFYGRRWRPRPAFRPWQVPMQPTPTMVTPMLQAPDLQAQQMQQLISAVSALTTKQNVKAPKGQNKKKQQKPKEKKENQKKKPTQKKKQQQKPKPQAKKKKPGRRERMCMKIENDCIFEVKLDGKVTGYACLVGDKVMKPAHVKGTIDNPDLAKLTYKKSSKYDLECAQIPVHMKSDASKYTHEKPEGHYNWHHGAVQYSGGRFTIPTGAGKPGDSGRPIFDNKGRVVAIVLGGANEGARTALSVVTWTKDMVTRVTPEGTEEWSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEASDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSLEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTQTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 155 - DNA, 810 bp, Ross river virus
atgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaagaaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtgg

SEQ ID NO: 156 - DNA, 8174 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaagaaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtggtctgccgcgctgatgatgtgtatccttgccaacacctctttcccctgctcatcacctccctgctacccctgctgctacgaaaaacagccagaacagacactgcggatgctggaagacaatgtgaatagaccagggtactatgagctactggaagcgtccatgacatgcagaaacagatcacgccaccgccgtagtgtaacagagcacttcaatgtgtataaggctactagaccgtacttagcgtattgcgctgactgtggggacgggtacttctgctatagcccagttgctatcgagaagatccgagatgaggcgtctgacggcatgctcaagatccaagtctccgcccaaataggtctggacaaggcaggtacccacgcccacacgaagatccgatatatggctggtcatgatgttcaggaatctaagagagattccttgagggtgtacacgtccgcagcgtgctctatacatgggacgatgggacacttcatcgtcgcacattgtccgccaggcgactacctcaaggtttcgttcgaggacgcagattcacacgtgaaggcatgtaaggtccaatacaagcacgacccattgccggtgggtagagagaagttcgtggttagaccccactttggcgtagagctgccatgcacctcataccagctgacaacagctcccaccgacgaggagatcgacatgcacacaccgccagatataccggatcgcaccctgctatcacagacggcgggcaacgtcaaaataacagcaggcggcaggactatcaggtacaattgtacctgtggccgtgacaacgtaggcactaccagtactgacaagaccatcaacacatgcaagattgaccaatgccatgctgccgttaccagccatgacaaatggcaatttacctctccatttgttcccagggctgatcagacagctaggaggggcaaagtgcatgttccattccctttgactaacgtcacctgccgagtgccgttggctcgagcgccggatgtcacctatggtaagaaggaggtgaccctgagattacacccagatcatccgacgctcttctcctataggagtttaggagccgaaccgcacccgtacgaggagtgggttgacaagttctctgagcgcatcatcccagtgacggaagaagggattgagtaccagtggggcaacaacccgccggtccgcctatgggcgcaactgacgaccgagggcaaaccccatggctggccacatgaaatcattcagtactattatggactataccccgccgccaccattgccgcagtatccggggcgagtctgatggccctcctaactctagcggccacatgctgcatgctggccaccgcgaggagaaagtgcctaacaccatacgccttgacgccaggagcggtggtaccgttgacactggggctgctttgctgcgcaccgagggcgaacgcagcatcattcgctgagactatggcatatctgtgggacgagaacaaaaccctcttttggatggaattcgcggccccagccgcagcgcttgctttgctggcatgctgtatcaaaagcctgatctgctgttgtaagccattttcttttttagtgttactgagcctgggagcctccgcaaaagcttacgagcacacagccacaattccgaatgtggtggggttcccgtataaggctcacattgaaaggaatggcttctcgcccatgactctgcagcttgaagtggtggagacaagcttggaacccacacttaacctggagtacattacctgcgaatacaagacggtggtcccttcgccattcatcaaatgttgcggaacatcagaatgctcatccaaggagcagccagactaccaatgcaaggtgtacacgggtgtatacccattcatgtggggtggagcctactgtttctgcgactccgagaacacgcagctcagcgaggcctatgtcgacaggtcagacgtttgcaaacatgatcacgcatcggcctacaaggcacacacggcctctctaaaagcaacaatcaggatcagttatggcaccatcaaccagaccaccgaggccttcgttaatggtgaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggtagattcggagacattcagagcaggacagtggagagcaaagacttgtatgccaacacggccctaaaactctcaagaccatcacccggggttgtgcatgtgccatacacgcagacaccatccggatttaaatattggctgaaggagaaaggatcttcattgaatacaaaggccccttttggctgcaagataaagaccaatccagtcagagccatggattgtgcagttggcagtatacctgtgtcgatggacatacctgacagtgcattcacacgagtggtagatgccccggctgtaacagacctgagctgccaggtagtggtctgtacacactcctccgatttcggaggagttgccacattgtcttacaaaacggacaaacccggcaagtgcgctgtccactcacattccaacgtcgcaacgttgcaagaggcgacggtggatgtcaaggaggatggcaaggtcacagtgcacttttccacggcgtccgcctccccggccttcaaagtgtccgtctgtgacgcaaaaacaacgtgcacggcggcgtgcgagcctccaaaagaccacatcgtcccttatggggcgagccataacaaccaggtctttccggacatgtcaggaactgcgatgacgtgggtgcagaggctggccagtgggttaggtgggctggctctcatcgcggtggttgtgctggtcttggtaacctgcataacaatgcgtcggtaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 157 - protein, 1254 aa, Ross river virus
MNYIPTQTFYGRRWRPRPAFRPWQVPMQPTPTMVTPMLQAPDLQAQQMQQLISAVSALTTKQNVKAPKGQNNKKQQKPKEKKENQKKKPTQKKKQQQKPKPQAKKKKPGRRERMCMKIENDCIFEVKLDGKVTGYACLVGDKVMKPAHVKGTIDNPDLAKLTYKKSSKYDLECAQIPVHMKSDASKYTHEKPEGHYNWHHGAVQYSGGRFTIPTGAGKPGDSGRPIFDNKGRVVAIVLGGANEGARTALSVVTWTKDMVTRVTPEGTEEWSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEASDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSLEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTQTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 158 - DNA, 810 bp, Ross river virus
atgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaataaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtgg

SEQ ID NO: 159 - DNA, 8174 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaataaacagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtggtctgccgcgctgatgatgtgtatccttgccaacacctctttcccctgctcatcacctccctgctacccctgctgctacgaaaaacagccagaacagacactgcggatgctggaagacaatgtgaatagaccagggtactatgagctactggaagcgtccatgacatgcagaaacagatcacgccaccgccgtagtgtaacagagcacttcaatgtgtataaggctactagaccgtacttagcgtattgcgctgactgtggggacgggtacttctgctatagcccagttgctatcgagaagatccgagatgaggcgtctgacggcatgctcaagatccaagtctccgcccaaataggtctggacaaggcaggtacccacgcccacacgaagatccgatatatggctggtcatgatgttcaggaatctaagagagattccttgagggtgtacacgtccgcagcgtgctctatacatgggacgatgggacacttcatcgtcgcacattgtccgccaggcgactacctcaaggtttcgttcgaggacgcagattcacacgtgaaggcatgtaaggtccaatacaagcacgacccattgccggtgggtagagagaagttcgtggttagaccccactttggcgtagagctgccatgcacctcataccagctgacaacagctcccaccgacgaggagatcgacatgcacacaccgccagatataccggatcgcaccctgctatcacagacggcgggcaacgtcaaaataacagcaggcggcaggactatcaggtacaattgtacctgtggccgtgacaacgtaggcactaccagtactgacaagaccatcaacacatgcaagattgaccaatgccatgctgccgttaccagccatgacaaatggcaatttacctctccatttgttcccagggctgatcagacagctaggaggggcaaagtgcatgttccattccctttgactaacgtcacctgccgagtgccgttggctcgagcgccggatgtcacctatggtaagaaggaggtgaccctgagattacacccagatcatccgacgctcttctcctataggagtttaggagccgaaccgcacccgtacgaggagtgggttgacaagttctctgagcgcatcatcccagtgacggaagaagggattgagtaccagtggggcaacaacccgccggtccgcctatgggcgcaactgacgaccgagggcaaaccccatggctggccacatgaaatcattcagtactattatggactataccccgccgccaccattgccgcagtatccggggcgagtctgatggccctcctaactctagcggccacatgctgcatgctggccaccgcgaggagaaagtgcctaacaccatacgccttgacgccaggagcggtggtaccgttgacactggggctgctttgctgcgcaccgagggcgaacgcagcatcattcgctgagactatggcatatctgtgggacgagaacaaaaccctcttttggatggaattcgcggccccagccgcagcgcttgctttgctggcatgctgtatcaaaagcctgatctgctgttgtaagccattttcttttttagtgttactgagcctgggagcctccgcaaaagcttacgagcacacagccacaattccgaatgtggtggggttcccgtataaggctcacattgaaaggaatggcttctcgcccatgactctgcagcttgaagtggtggagacaagcttggaacccacacttaacctggagtacattacctgcgaatacaagacggtggtcccttcgccattcatcaaatgttgcggaacatcagaatgctcatccaaggagcagccagactaccaatgcaaggtgtacacgggtgtatacccattcatgtggggtggagcctactgtttctgcgactccgagaacacgcagctcagcgaggcctatgtcgacaggtcagacgtttgcaaacatgatcacgcatcggcctacaaggcacacacggcctctctaaaagcaacaatcaggatcagttatggcaccatcaaccagaccaccgaggccttcgttaatggtgaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggtagattcggagacattcagagcaggacagtggagagcaaagacttgtatgccaacacggccctaaaactctcaagaccatcacccggggttgtgcatgtgccatacacgcagacaccatccggatttaaatattggctgaaggagaaaggatcttcattgaatacaaaggccccttttggctgcaagataaagaccaatccagtcagagccatggattgtgcagttggcagtatacctgtgtcgatggacatacctgacagtgcattcacacgagtggtagatgccccggctgtaacagacctgagctgccaggtagtggtctgtacacactcctccgatttcggaggagttgccacattgtcttacaaaacggacaaacccggcaagtgcgctgtccactcacattccaacgtcgcaacgttgcaagaggcgacggtggatgtcaaggaggatggcaaggtcacagtgcacttttccacggcgtccgcctccccggccttcaaagtgtccgtctgtgacgcaaaaacaacgtgcacggcggcgtgcgagcctccaaaagaccacatcgtcccttatggggcgagccataacaaccaggtctttccggacatgtcaggaactgcgatgacgtgggtgcagaggctggccagtgggttaggtgggctggctctcatcgcggtggttgtgctggtcttggtaacctgcataacaatgcgtcggtaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 160 - protein, 1254 aa, Ross river virus
MNYIPTQTFYGRRWRPRPAFRPWQVPMQPTPTMVTPMLQAPDLQAQQMQQLISAVSALTTKQNVKAPKGQNNNKQQKPKEKKENQKKKPTQKKKQQQKPKPQAKKKKPGRRERMCMKIENDCIFEVKLDGKVTGYACLVGDKVMKPAHVKGTIDNPDLAKLTYKKSSKYDLECAQIPVHMKSDASKYTHEKPEGHYNWHHGAVQYSGGRFTIPTGAGKPGDSGRPIFDNKGRVVAIVLGGANEGARTALSVVTWTKDMVTRVTPEGTEEWSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEASDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSLEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTQTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 161 - DNA, 810 bp, Ross river virus
atgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaataatcagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtgg

SEQ ID NO: 162 - DNA, 8171 bp, Artificial Sequence
  Synthetic polynucleotide
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatatcgcggccgctctagacaccatgaattacataccaacccagactttttacggacgccgttggcggcctcgcccggcgttccgtccatggcaggtgccgatgcagccgacacctactatggttacacccatgctgcaagcaccagacctacaggcccaacagatgcaacaactgatcagcgctgtctctgcattaaccaccaaacagaatgtaaaagcaccaaaagggcaaaataacaataatcagcagaaaccaaaggaaaagaaggaaaaccagaagaaaaagccgacgcaaaagaagaagcagcagcagaaaccaaaaccacaggctaagaagaagaaaccagggagaagagaaagaatgtgcatgaagatcgagaatgactgcatattcgaggtcaaactggatggcaaggttaccggttatgcgtgcctagtcggagacaaggtcatgaagccggctcacgttaaaggcacaattgataacccagaccttgcgaagctgacttacaagaaatccagtaagtatgacctcgaatgcgcccagataccagtgcacatgaagtccgacgcctccaagtacacacatgaaaaacccgaaggtcattacaattggcaccatggagcagtgcagtacagcggaggaaggtttaccatccccacaggcgccggcaaaccgggagatagcggtaggcctatttttgacaacaaagggcgagtagtggccatcgtgttaggcggggccaacgaaggtgctcgcactgcgctgtctgtggtgacgtggacaaaagacatggtcactcgggtaacgccagaaggaactgaagagtggtctgccgcgctgatgatgtgtatccttgccaacacctctttcccctgctcatcacctccctgctacccctgctgctacgaaaaacagccagaacagacactgcggatgctggaagacaatgtgaatagaccagggtactatgagctactggaagcgtccatgacatgcagaaacagatcacgccaccgccgtagtgtaacagagcacttcaatgtgtataaggctactagaccgtacttagcgtattgcgctgactgtggggacgggtacttctgctatagcccagttgctatcgagaagatccgagatgaggcgtctgacggcatgctcaagatccaagtctccgcccaaataggtctggacaaggcaggtacccacgcccacacgaagatccgatatatggctggtcatgatgttcaggaatctaagagagattccttgagggtgtacacgtccgcagcgtgctctatacatgggacgatgggacacttcatcgtcgcacattgtccgccaggcgactacctcaaggtttcgttcgaggacgcagattcacacgtgaaggcatgtaaggtccaatacaagcacgacccattgccggtgggtagagagaagttcgtggttagaccccactttggcgtagagctgccatgcacctcataccagctgacaacagctcccaccgacgaggagatcgacatgcacacaccgccagatataccggatcgcaccctgctatcacagacggcgggcaacgtcaaaataacagcaggcggcaggactatcaggtacaattgtacctgtggccgtgacaacgtaggcactaccagtactgacaagaccatcaacacatgcaagattgaccaatgccatgctgccgttaccagccatgacaaatggcaatttacctctccatttgttcccagggctgatcagacagctaggaggggcaaagtgcatgttccattccctttgactaacgtcacctgccgagtgccgttggctcgagcgccggatgtcacctatggtaagaaggaggtgaccctgagattacacccagatcatccgacgctcttctcctataggagtttaggagccgaaccgcacccgtacgaggagtgggttgacaagttctctgagcgcatcatcccagtgacggaagaagggattgagtaccagtggggcaacaacccgccggtccgcctatgggcgcaactgacgaccgagggcaaaccccatggctggccacatgaaatcattcagtactattatggactataccccgccgccaccattgccgcagtatccggggcgagtctgatggccctcctaactctagcggccacatgctgcatgctggccaccgcgaggagaaagtgcctaacaccatacgccttgacgccaggagcggtggtaccgttgacactggggctgctttgctgcgcaccgagggcgaacgcagcatcattcgctgagactatggcatatctgtgggacgagaacaaaaccctcttttggatggaattcgcggccccagccgcagcgcttgctttgctggcatgctgtatcaaaagcctgatctgctgttgtaagccattttcttttttagtgttactgagcctgggagcctccgcaaaagcttacgagcacacagccacaattccgaatgtggtggggttcccgtataaggctcacattgaaaggaatggcttctcgcccatgactctgcagcttgaagtggtggagacaagcttggaacccacacttaacctggagtacattacctgcgaatacaagacggtggtcccttcgccattcatcaaatgttgcggaacatcagaatgctcatccaaggagcagccagactaccaatgcaaggtgtacacgggtgtatacccattcatgtggggtggagcctactgtttctgcgactccgagaacacgcagctcagcgaggcctatgtcgacaggtcagacgtttgcaaacatgatcacgcatcggcctacaaggcacacacggcctctctaaaagcaacaatcaggatcagttatggcaccatcaaccagaccaccgaggccttcgttaatggtgaacacgcggtcaacgtgggcggaagcaagttcatctttggaccgatctcaacagcttggtcaccgttcgacaataaaattgtcgtgtataaagatgatgtctacaaccaggacttcccaccctacggatcaggccagccgggtagattcggagacattcagagcaggacagtggagagcaaagacttgtatgccaacacggccctaaaactctcaagaccatcacccggggttgtgcatgtgccatacacgcagacaccatccggatttaaatattggctgaaggagaaaggatcttcattgaatacaaaggccccttttggctgcaagataaagaccaatccagtcagagccatggattgtgcagttggcagtatacctgtgtcgatggacatacctgacagtgcattcacacgagtggtagatgccccggctgtaacagacctgagctgccaggtagtggtctgtacacactcctccgatttcggaggagttgccacattgtcttacaaaacggacaaacccggcaagtgcgctgtccactcacattccaacgtcgcaacgttgcaagaggcgacggtggatgtcaaggaggatggcaaggtcacagtgcacttttccacggcgtccgcctccccggccttcaaagtgtccgtctgtgacgcaaaaacaacgtgcacggcggcgtgcgagcctccaaaagaccacatcgtcccttatggggcgagccataacaaccaggtctttccggacatgtcaggaactgcgatgacgtgggtgcagaggctggccagtgggttaggtgggctggctctcatcgcggtggttgtgctggtcttggtaacctgcataacaatgcgtcggtaaggatccagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttc

SEQ ID NO: 163 - protein, 1254 aa, Ross river virus
MNYIPTQTFYGRRWRPRPAFRPWQVPMQPTPTMVTPMLQAPDLQAQQMQQLISAVSALTTKQNVKAPKGQNNNNQQKPKEKKENQKKKPTQKKKQQQKPKPQAKKKKPGRRERMCMKIENDCIFEVKLDGKVTGYACLVGDKVMKPAHVKGTIDNPDLAKLTYKKSSKYDLECAQIPVHMKSDASKYTHEKPEGHYNWHHGAVQYSGGRFTIPTGAGKPGDSGRPIFDNKGRVVAIVLGGANEGARTALSVVTWTKDMVTRVTPEGTEEWSAALMMCILANTSFPCSSPPCYPCCYEKQPEQTLRMLEDNVNRPGYYELLEASMTCRNRSRHRRSVTEHFNVYKATRPYLAYCADCGDGYFCYSPVAIEKIRDEASDGMLKIQVSAQIGLDKAGTHAHTKIRYMAGHDVQESKRDSLRVYTSAACSIHGTMGHFIVAHCPPGDYLKVSFEDADSHVKACKVQYKHDPLPVGREKFVVRPHFGVELPCTSYQLTTAPTDEEIDMHTPPDIPDRTLLSQTAGNVKITAGGRTIRYNCTCGRDNVGTTSTDKTINTCKIDQCHAAVTSHDKWQFTSPFVPRADQTARRGKVHVPFPLTNVTCRVPLARAPDVTYGKKEVTLRLHPDHPTLFSYRSLGAEPHPYEEWVDKFSERIIPVTEEGIEYQWGNNPPVRLWAQLTTEGKPHGWPHEIIQYYYGLYPAATIAAVSGASLMALLTLAATCCMLATARRKCLTPYALTPGAVVPLTLGLLCCAPRANAASFAETMAYLWDENKTLFWMEFAAPAAALALLACCIKSLICCCKPFSFLVLLSLGASAKAYEHTATIPNVVGFPYKAHIERNGFSPMTLQLEVVETSLEPTLNLEYITCEYKTVVPSPFIKCCGTSECSSKEQPDYQCKVYTGVYPFMWGGAYCFCDSENTQLSEAYVDRSDVCKHDHASAYKAHTASLKATIRISYGTINQTTEAFVNGEHAVNVGGSKFIFGPISTAWSPFDNKIVVYKDDVYNQDFPPYGSGQPGRFGDIQSRTVESKDLYANTALKLSRPSPGVVHVPYTQTPSGFKYWLKEKGSSLNTKAPFGCKIKTNPVRAMDCAVGSIPVSMDIPDSAFTRVVDAPAVTDLSCQVVVCTHSSDFGGVATLSYKTDKPGKCAVHSHSNVATLQEATVDVKEDGKVTVHFSTASASPAFKVSVCDAKTTCTAACEPPKDHIVPYGASHNNQVFPDMSGTAMTWVQRLASGLGGLALIAVVVLVLVTCITMRR

SEQ ID NO: 164 - DNA, 759 bp, Barmah Forest virus
atggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacagaagaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtgg

SEQ ID NO: 165 - DNA, 3717 bp, Barmah Forest virus
  modified_base (775)..(775): a, c, t, g, unknown or other
  misc_feature (775)..(775): n is a, c, g, or t
atggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacagaagaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtggtcggcggccgcactgnatataacagcactatgtgtcctccagaacttatcgttcccgtgtgatgcaccaccatgtgcaccatgctgttacgaaaaagaccctgcagggaccctaagattgctgtctgaccactactaccaccccaagtattatgaattacttgactcgacgatgcactgcccacaaggaaggagacctaagaggtctgttgcgcatttcgaagcctacaaggctacgagaccgtatatagggtggtgcgcagattgtggactggcaggatcatgcccatcccctgtgagcatcgagcacgtctggagtgatgccgacgacggcgtactgaagatccaagtgtccatgcagatcggtatagctaaaagcaatactattaaccacgctaagatacgttacatgggtgccaatggagtacaggaggctgaacgctctaccctaagtgtatccacaacagcaccatgtgacatcttggcgaccatgggccatttcatcttggcccgctgccgacccggcagtcaagttgaagtatcactaagcaccgatccaaagctgctatgccgtacaccattctcccacaagcccaggtttattggcaatgaaaagtccccagcacccaccgggcacaagacccgaattccctgcaaaacttactcccatcagacagacttaacgagagaagagattacaatgcatgtaccgccggatgtccccatccaagggctagtgtccaatacaggtaagtcgtactcattagacccaaagacgaagaccatcaagtacaaatgcacttgcggcgagactgtaaaagaaggtactgctacgaacaaaatcacactgttcaattgtgacaccgccccaaagtgtattacatatgcagtggataacacagtgtggcagtacaactcccaatacgtgcccaggtccgaagttacggaggtgaaaggaaagatccatgtgcctttccctctgaccgacagcacgtgtgcagtcagcgtagcacctgaaccgcaagtgacatacagactgggggaagtggagttccacttccaccctatgtaccccaccctcttctccattaggagcctcggaaaggatccgagccacagtcaagaatggatagatacacccatgagcaagacaatccaagttggggcagaaggcgtggagtatgtctggggaaacaacaacccggtacgactatgggcacagaagagctcatcgagcagcgcgcatggtaaccctattagcatagtctcacattactatgacctgtacccttactggaccatcacagtactagcgagtctaggcttgctaatagtgattagttccggtttttcatgctttttgtgttcagtcgctcgaaccaaatgccttacaccctatcaattagcaccaggcgcccaattacccacatttatagcactcctttgctgcgctaagtctgcacgcgcagacactttagatgatttttcctacctgtggaccaacaaccaagccatgttttggctccaactggcatctccggttgcagcgttcttgtgcttatcctattgctgtagaaatctagcatgctgtatgaagatttttttagggataagcggcctgtgtgtaattgccacgcaggcctacgagcactcaaccacgatgccgaatcaggtgggaataccgtttaaagccttgatagagcgaccaggttacgcaggcctcccgctatctttagtagtgattaagtcagaattagtcccctcattagttcaggattatattacctgcaactacaagactgtggtcccgtctccgtacattaaatgttgcggaggcgctgagtgttcacacaaaaatgaagcggactataagtgctcggtgttcacaggcgtgtacccgtttatgtggggaggcgcctactgcttctgtgacaccgaaaacagtcagatgagtgaagtatacgtaaccagaggagaatcatgcgaggctgaccatgccatcgcttatcaggtacacacagcatcgcttaaggcacaagtaatgatatcgattggagaactgaaccaaaccgtcgacgtgtttgtcaacggagacagtccagccagaatccaacaatcaaagttcatacttgggccgatatccagtgcctggtctccttttgatcacaaggtgatcgtatacagggatgaggtgtacaatgaagactacgcaccgtacggatccggccaagcaggcaggttcggagacatccaaagtagaactgttaacagcactgatgtctatgccaacaccaatttgaagcttaaaagaccggcttcaggcaatgttcatgtaccatacacgcaaaccccttcgggtttctcgtactggaaaaaagagaagggagtaccattgaatcgaaacgccccttttggctgtatcatcaaagtcaatccagtacgtgctgaaaactgcgtatatggcaacataccgatcagtatggatattgcggacgcgcacttcacaaggatcgatgaatccccgtctgtgtccttgaaggcgtgtgaagtgcagtcctgcacttattcatcggattttggcggagtagcgagcatttcctacacatctaataaggtaggtaagtgtgccatccacagccactcgaactccgcaacgatgaaggattctgtgcaggatgtccaggaaagcggcgccttgtcgcttttctttgcgacttcctctgtcgagccgaacttcgtggtccaagtgtgtaacgcgcggatcacttgccatggtaagtgtgaaccaccgaaagaccacatcgtaccatacgcagccaaacacaacgacgccgagtttccatccatctctactacagcttggcaatggttggcacacaccacctcagggccactcaccatacttgtggtagctattatagtcgttgttgtagtatccattgtagtatgtgcaagacac

SEQ ID NO: 166 - DNA, 8109 bp, Artificial Sequence
  Synthetic polynucleotide
  modified_base (2144)..(2144): a, c, t, g, unknown or other
  misc_feature (2144)..(2144): n is a, c, g, or t
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatctgcaccatggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacagaagaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtggtcggcggccgcactgnatataacagcactatgtgtcctccagaacttatcgttcccgtgtgatgcaccaccatgtgcaccatgctgttacgaaaaagaccctgcagggaccctaagattgctgtctgaccactactaccaccccaagtattatgaattacttgactcgacgatgcactgcccacaaggaaggagacctaagaggtctgttgcgcatttcgaagcctacaaggctacgagaccgtatatagggtggtgcgcagattgtggactggcaggatcatgcccatcccctgtgagcatcgagcacgtctggagtgatgccgacgacggcgtactgaagatccaagtgtccatgcagatcggtatagctaaaagcaatactattaaccacgctaagatacgttacatgggtgccaatggagtacaggaggctgaacgctctaccctaagtgtatccacaacagcaccatgtgacatcttggcgaccatgggccatttcatcttggcccgctgccgacccggcagtcaagttgaagtatcactaagcaccgatccaaagctgctatgccgtacaccattctcccacaagcccaggtttattggcaatgaaaagtccccagcacccaccgggcacaagacccgaattccctgcaaaacttactcccatcagacagacttaacgagagaagagattacaatgcatgtaccgccggatgtccccatccaagggctagtgtccaatacaggtaagtcgtactcattagacccaaagacgaagaccatcaagtacaaatgcacttgcggcgagactgtaaaagaaggtactgctacgaacaaaatcacactgttcaattgtgacaccgccccaaagtgtattacatatgcagtggataacacagtgtggcagtacaactcccaatacgtgcccaggtccgaagttacggaggtgaaaggaaagatccatgtgcctttccctctgaccgacagcacgtgtgcagtcagcgtagcacctgaaccgcaagtgacatacagactgggggaagtggagttccacttccaccctatgtaccccaccctcttctccattaggagcctcggaaaggatccgagccacagtcaagaatggatagatacacccatgagcaagacaatccaagttggggcagaaggcgtggagtatgtctggggaaacaacaacccggtacgactatgggcacagaagagctcatcgagcagcgcgcatggtaaccctattagcatagtctcacattactatgacctgtacccttactggaccatcacagtactagcgagtctaggcttgctaatagtgattagttccggtttttcatgctttttgtgttcagtcgctcgaaccaaatgccttacaccctatcaattagcaccaggcgcccaattacccacatttatagcactcctttgctgcgctaagtctgcacgcgcagacactttagatgatttttcctacctgtggaccaacaaccaagccatgttttggctccaactggcatctccggttgcagcgttcttgtgcttatcctattgctgtagaaatctagcatgctgtatgaagatttttttagggataagcggcctgtgtgtaattgccacgcaggcctacgagcactcaaccacgatgccgaatcaggtgggaataccgtttaaagccttgatagagcgaccaggttacgcaggcctcccgctatctttagtagtgattaagtcagaattagtcccctcattagttcaggattatattacctgcaactacaagactgtggtcccgtctccgtacattaaatgttgcggaggcgctgagtgttcacacaaaaatgaagcggactataagtgctcggtgttcacaggcgtgtacccgtttatgtggggaggcgcctactgcttctgtgacaccgaaaacagtcagatgagtgaagtatacgtaaccagaggagaatcatgcgaggctgaccatgccatcgcttatcaggtacacacagcatcgcttaaggcacaagtaatgatatcgattggagaactgaaccaaaccgtcgacgtgtttgtcaacggagacagtccagccagaatccaacaatcaaagttcatacttgggccgatatccagtgcctggtctccttttgatcacaaggtgatcgtatacagggatgaggtgtacaatgaagactacgcaccgtacggatccggccaagcaggcaggttcggagacatccaaagtagaactgttaacagcactgatgtctatgccaacaccaatttgaagcttaaaagaccggcttcaggcaatgttcatgtaccatacacgcaaaccccttcgggtttctcgtactggaaaaaagagaagggagtaccattgaatcgaaacgccccttttggctgtatcatcaaagtcaatccagtacgtgctgaaaactgcgtatatggcaacataccgatcagtatggatattgcggacgcgcacttcacaaggatcgatgaatccccgtctgtgtccttgaaggcgtgtgaagtgcagtcctgcacttattcatcggattttggcggagtagcgagcatttcctacacatctaataaggtaggtaagtgtgccatccacagccactcgaactccgcaacgatgaaggattctgtgcaggatgtccaggaaagcggcgccttgtcgcttttctttgcgacttcctctgtcgagccgaacttcgtggtccaagtgtgtaacgcgcggatcacttgccatggtaagtgtgaaccaccgaaagaccacatcgtaccatacgcagccaaacacaacgacgccgagtttccatccatctctactacagcttggcaatggttggcacacaccacctcagggccactcaccatacttgtggtagctattatagtcgttgttgtagtatccattgtagtatgtgcaagacactagagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 167 - protein, 253 aa, Barmah Forest virus
MDFIPTQTFYGRRWRPAPVQRYIPQPQPPAPPRRRRGPSQLQQLVAALGALALQPKQKQKRAQKKPKKTPPPKPKKTQKPKKPTQKKKSKPGKRMRNCMKIENDCIFPVMLDGKVNGYACLVGDKVMKPAHVKGTIDNPELAKLTFKKSSKYDLECAQVPVCMKSDASKFTHEKPEGHYNWHHGAVQFSNGRFTIPTGSGKPGDSGRPIFDNTGKVVAIVLGGANEGARTALSVVTWNKDMVTRITPEESVEW

SEQ ID NO: 168 - DNA, 759 bp, Barmah Forest virus
atggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacaggcgaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtgg

SEQ ID NO: 169 - DNA, 3717 bp, Barmah Forest virus
  modified_base (775)..(775): a, c, t, g, unknown or other
  misc_feature (775)..(775): n is a, c, g, or t
atggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacaggcgaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagccctatccgtggtcacctggaataaggatatggtgacccgcataacacctgaagaatcagtggagtggtcggcggccgcactgnatataacagcactatgtgtcctccagaacttatcgttcccgtgtgatgcaccaccatgtgcaccatgctgttacgaaaaagaccctgcagggaccctaagattgctgtctgaccactactaccaccccaagtattatgaattacttgactcgacgatgcactgcccacaaggaaggagacctaagaggtctgttgcgcatttcgaagcctacaaggctacgagaccgtatatagggtggtgcgcagattgtggactggcaggatcatgcccatcccctgtgagcatcgagcacgtctggagtgatgccgacgacggcgtactgaagatccaagtgtccatgcagatcggtatagctaaaagcaatactattaaccacgctaagatacgttacatgggtgccaatggagtacaggaggctgaacgctctaccctaagtgtatccacaacagcaccatgtgacatcttggcgaccatgggccatttcatcttggcccgctgccgacccggcagtcaagttgaagtatcactaagcaccgatccaaagctgctatgccgtacaccattctcccacaagcccaggtttattggcaatgaaaagtccccagcacccaccgggcacaagacccgaattccctgcaaaacttactcccatcagacagacttaacgagagaagagattacaatgcatgtaccgccggatgtccccatccaagggctagtgtccaatacaggtaagtcgtactcattagacccaaagacgaagaccatcaagtacaaatgcacttgcggcgagactgtaaaagaaggtactgctacgaacaaaatcacactgttcaattgtgacaccgccccaaagtgtattacatatgcagtggataacacagtgtggcagtacaactcccaatacgtgcccaggtccgaagttacggaggtgaaaggaaagatccatgtgcctttccctctgaccgacagcacgtgtgcagtcagcgtagcacctgaaccgcaagtgacatacagactgggggaagtggagttccacttccaccctatgtaccccaccctcttctccattaggagcctcggaaaggatccgagccacagtcaagaatggatagatacacccatgagcaagacaatccaagttggggcagaaggcgtggagtatgtctggggaaacaacaacccggtacgactatgggcacagaagagctcatcgagcagcgcgcatggtaaccctattagcatagtctcacattactatgacctgtacccttactggaccatcacagtactagcgagtctaggcttgctaatagtgattagttccggtttttcatgctttttgtgttcagtcgctcgaaccaaatgccttacaccctatcaattagcaccaggcgcccaattacccacatttatagcactcctttgctgcgctaagtctgcacgcgcagacactttagatgatttttcctacctgtggaccaacaaccaagccatgttttggctccaactggcatctccggttgcagcgttcttgtgcttatcctattgctgtagaaatctagcatgctgtatgaagatttttttagggataagcggcctgtgtgtaattgccacgcaggcctacgagcactcaaccacgatgccgaatcaggtgggaataccgtttaaagccttgatagagcgaccaggttacgcaggcctcccgctatctttagtagtgattaagtcagaattagtcccctcattagttcaggattatattacctgcaactacaagactgtggtcccgtctccgtacattaaatgttgcggaggcgctgagtgttcacacaaaaatgaagcggactataagtgctcggtgttcacaggcgtgtacccgtttatgtggggaggcgcctactgcttctgtgacaccgaaaacagtcagatgagtgaagtatacgtaaccagaggagaatcatgcgaggctgaccatgccatcgcttatcaggtacacacagcatcgcttaaggcacaagtaatgatatcgattggagaactgaaccaaaccgtcgacgtgtttgtcaacggagacagtccagccagaatccaacaatcaaagttcatacttgggccgatatccagtgcctggtctccttttgatcacaaggtgatcgtatacagggatgaggtgtacaatgaagactacgcaccgtacggatccggccaagcaggcaggttcggagacatccaaagtagaactgttaacagcactgatgtctatgccaacaccaatttgaagcttaaaagaccggcttcaggcaatgttcatgtaccatacacgcaaaccccttcgggtttctcgtactggaaaaaagagaagggagtaccattgaatcgaaacgccccttttggctgtatcatcaaagtcaatccagtacgtgctgaaaactgcgtatatggcaacataccgatcagtatggatattgcggacgcgcacttcacaaggatcgatgaatccccgtctgtgtccttgaaggcgtgtgaagtgcagtcctgcacttattcatcggattttggcggagtagcgagcatttcctacacatctaataaggtaggtaagtgtgccatccacagccactcgaactccgcaacgatgaaggattctgtgcaggatgtccaggaaagcggcgccttgtcgcttttctttgcgacttcctctgtcgagccgaacttcgtggtccaagtgtgtaacgcgcggatcacttgccatggtaagtgtgaaccaccgaaagaccacatcgtaccatacgcagccaaacacaacgacgccgagtttccatccatctctactacagcttggcaatggttggcacacaccacctcagggccactcaccatacttgtggtagctattatagtcgttgttgtagtatccattgtagtatgtgcaagacac

SEQ ID NO: 170 - DNA, 8109 bp, Artificial Sequence
  Synthetic polynucleotide
  modified_base (83)..(83): a, c, t, g, unknown or other
  misc_feature (83)..(83): n is a, c, g, or t
cctatccgtggtcacctggaataaggatatggtgacccgcataacacctgaagaatcagtggagtggtcggcggccgcactgnatataacagcactatgtgtcctccagaacttatcgttcccgtgtgatgcaccaccatgtgcaccatgctgttacgaaaaagaccctgcagggaccctaagattgctgtctgaccactactaccaccccaagtattatgaattacttgactcgacgatgcactgcccacaaggaaggagacctaagaggtctgttgcgcatttcgaagcctacaaggctacgagaccgtatatagggtggtgcgcagattgtggactggcaggatcatgcccatcccctgtgagcatcgagcacgtctggagtgatgccgacgacggcgtactgaagatccaagtgtccatgcagatcggtatagctaaaagcaatactattaaccacgctaagatacgttacatgggtgccaatggagtacaggaggctgaacgctctaccctaagtgtatccacaacagcaccatgtgacatcttggcgaccatgggccatttcatcttggcccgctgccgacccggcagtcaagttgaagtatcactaagcaccgatccaaagctgctatgccgtacaccattctcccacaagcccaggtttattggcaatgaaaagtccccagcacccaccgggcacaagacccgaattccctgcaaaacttactcccatcagacagacttaacgagagaagagattacaatgcatgtaccgccggatgtccccatccaagggctagtgtccaatacaggtaagtcgtactcattagacccaaagacgaagaccatcaagtacaaatgcacttgcggcgagactgtaaaagaaggtactgctacgaacaaaatcacactgttcaattgtgacaccgccccaaagtgtattacatatgcagtggataacacagtgtggcagtacaactcccaatacgtgcccaggtccgaagttacggaggtgaaaggaaagatccatgtgcctttccctctgaccgacagcacgtgtgcagtcagcgtagcacctgaaccgcaagtgacatacagactgggggaagtggagttccacttccaccctatgtaccccaccctcttctccattaggagcctcggaaaggatccgagccacagtcaagaatggatagatacacccatgagcaagacaatccaagttggggcagaaggcgtggagtatgtctggggaaacaacaacccggtacgactatgggcacagaagagctcatcgagcagcgcgcatggtaaccctattagcatagtctcacattactatgacctgtacccttactggaccatcacagtactagcgagtctaggcttgctaatagtgattagttccggtttttcatgctttttgtgttcagtcgctcgaaccaaatgccttacaccctatcaattagcaccaggcgcccaattacccacatttatagcactcctttgctgcgctaagtctgcacgcgcagacactttagatgatttttcctacctgtggaccaacaaccaagccatgttttggctccaactggcatctccggttgcagcgttcttgtgcttatcctattgctgtagaaatctagcatgctgtatgaagatttttttagggataagcggcctgtgtgtaattgccacgcaggcctacgagcactcaaccacgatgccgaatcaggtgggaataccgtttaaagccttgatagagcgaccaggttacgcaggcctcccgctatctttagtagtgattaagtcagaattagtcccctcattagttcaggattatattacctgcaactacaagactgtggtcccgtctccgtacattaaatgttgcggaggcgctgagtgttcacacaaaaatgaagcggactataagtgctcggtgttcacaggcgtgtacccgtttatgtggggaggcgcctactgcttctgtgacaccgaaaacagtcagatgagtgaagtatacgtaaccagaggagaatcatgcgaggctgaccatgccatcgcttatcaggtacacacagcatcgcttaaggcacaagtaatgatatcgattggagaactgaaccaaaccgtcgacgtgtttgtcaacggagacagtccagccagaatccaacaatcaaagttcatacttgggccgatatccagtgcctggtctccttttgatcacaaggtgatcgtatacagggatgaggtgtacaatgaagactacgcaccgtacggatccggccaagcaggcaggttcggagacatccaaagtagaactgttaacagcactgatgtctatgccaacaccaatttgaagcttaaaagaccggcttcaggcaatgttcatgtaccatacacgcaaaccccttcgggtttctcgtactggaaaaaagagaagggagtaccattgaatcgaaacgccccttttggctgtatcatcaaagtcaatccagtacgtgctgaaaactgcgtatatggcaacataccgatcagtatggatattgcggacgcgcacttcacaaggatcgatgaatccccgtctgtgtccttgaaggcgtgtgaagtgcagtcctgcacttattcatcggattttggcggagtagcgagcatttcctacacatctaataaggtaggtaagtgtgccatccacagccactcgaactccgcaacgatgaaggattctgtgcaggatgtccaggaaagcggcgccttgtcgcttttctttgcgacttcctctgtcgagccgaacttcgtggtccaagtgtgtaacgcgcggatcacttgccatggtaagtgtgaaccaccgaaagaccacatcgtaccatacgcagccaaacacaacgacgccgagtttccatccatctctactacagcttggcaatggttggcacacaccacctcagggccactcaccatacttgtggtagctattatagtcgttgttgtagtatccattgtagtatgtgcaagacactagagatctgctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgggtacccaggtgctgaagaattgacccggttcctcctgggccagaaagaagcaggcacatccccttctctgtgacacaccctgtccacgcccctggttcttagttccagccccactcataggacactcatagctcaggagggctccgccttcaatcccacccgctaaagtacttggagcggtctctccctccctcatcagcccaccaaaccaaacctagcctccaagagtgggaagaaattaaagcaagataggctattaagtgcagagggagagaaaatgcctccaacatgtgaggaagtaatgagagaaatcatagaattttaaggccatgatttaaggccatcatggccttaatcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttccccccccccccattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccatcggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctagttaacggtggagggcagtgtagtctgagcagtactcgttgctgccgcgcgcgccaccagacataatagctgacagactaacagactgttcctttccatgggtcttttctgcagtcaccgtcgtcgacacgtgtgatcagatctgcaccatggatttcatccccacccaaaccttctatggtagacgatggagaccagcaccagtccagagatacataccccaaccccaaccaccagcgcctccacgccgtaggagaggaccatctcaactccaacagcttgtggctgcattgggcgcactagctctacaacccaagcagaaacaaaaaagagcacaggcgaagcccaagaagacaccaccaccaaaaccaaaaaagacccagaagcctaagaaaccaacccaaaagaagaagtccaaacccggcaaacgtatgcgtaactgcatgaagatcgagaatgactgcatctttccggtgatgctcgatggaaaggttaacggctacgcttgcttagtgggggataaagtcatgaaaccagctcatgtgaagggcacgatcgacaatccagaactagccaaattgacattcaagaaatctagcaagtatgatctagaatgtgctcaagtgccggtatgcatgaaatcagacgcatccaagttcacccatgagaaaccagaaggacattacaactggcaccatggggcagtgcaatttagcaatggtaggtttaccattccgacgggctctggcaaacctggagacagtggtaggcctatttttgacaataccggcaaggtagtagccatagtgctgggaggtgcaaatgaaggggcccggacagc

SEQ ID NO: 171 - protein, 253 aa, Barmah Forest virus
MDFIPTQTFYGRRWRPAPVQRYIPQPQPPAPPRRRRGPSQLQQLVAALGALALQPKQKQKRAQAKPKKTPPPKPKKTQKPKKPTQKKKSKPGKRMRNCMKIENDCIFPVMLDGKVNGYACLVGDKVMKPAHVKGTIDNPELAKLTFKKSSKYDLECAQVPVCMKSDASKFTHEKPEGHYNWHHGAVQFSNGRFTIPTGSGKPGDSGRPIFDNTGKVVAIVLGGANEGARTALSVVTWNKDMVTRITPEESVEW

SEQ ID NO: 172 - protein, 253 aa, Barmah Forest virus; identical to SEQ ID NO: 167
  VARIANT (64)..(64): /replace="Ala"
  misc_feature (64)..(65): /note="Residues given in the sequence have no preference with respect to those in the annotations for said positions"
  VARIANT (65)..(65): /replace="Ala" or "Asn"
  VARIANT (67)..(68): /replace="Ala" or "Asn"
  misc_feature (67)..(68): /note="Residues given in the sequence have no preference with respect to those in the annotations for said positions"

What is claimed is:

1. An alphavirus virus-like particle (VLP) comprising at least one altered viral protein selected from the group consisting of:

a. an alphavirus E2 protein comprising one or more alterations, relative to the wild-type amino acid sequence, at one or more amino acid locations corresponding to one or more amino acid locations selected from the group consisting of H170, K200, K233, K234, R251 and H256 of CHKV E2 protein; and b. an alphavirus capsid protein comprising one or more alterations, relative to the wild-type amino acid sequence, at a charged amino acid residue in the Nuclear Localization Signal (NLS);

wherein the at least one altered viral protein is capable of self-assembling into a VLP; and wherein the one or more alterations enhance VLP production.

2. The VLP of claim 1, wherein the one or more altered viral protein(s) are derived from a virus selected from the group consisting of Eastern equine encephalitis virus (EEEV), Western equine encephalitis virus (WEEV), Venezuelan equine encephalitis virus (VEEV), Semliki Forest virus (SFV), Chikungunya virus (CHIKV), O'nyong-nyong virus, Sindbis virus, Mayaro virus, Ross River virus, Barmah Forest virus, and Ockelbo virus.

3. The VLP of claim 1, wherein the one or more alteration in a charged amino acid residue in the NLS is in at least one amino acid region selected from the group consisting of:

a. amino acids 67-70 of an EEEV capsid protein;
b. amino acids 67-70 of an WEEV capsid protein;
c. amino acids 64-68 of an VEEV capsid protein;
d. amino acids 62-69 of a CHIKV capsid protein;
e. amino acids 71-74 of a Ross River virus capsid protein; and
f. amino acids 64-68 of a Barmah Forest virus capsid protein.

4. The VLP of claim 1, wherein the VLP comprises an agent to be introduced to a cell.

5. A method of inducing an immune response against an alphavirus in a subject, comprising administering to the subject an effective amount of the VLP of claim 1.

6. A pan-viral immunogenic composition comprising:

a. the VLP of claim 1; and b. a second alphavirus VLP comprising at least one altered viral protein selected from the group consisting of:

i. an alphavirus E2 protein comprising one or more alterations, relative to the wild-type sequence, at one or more amino acid locations corresponding to one or more amino acid locations selected from the group consisting of H170, H200, K233, K234, R251 and H256 of CHKV E2 protein; and ii. an alphavirus capsid protein comprising one or more alterations, relative to the wild-type sequence, at a charged amino acid residue in the Nuclear Localization Signal (NLS);

wherein the at least one altered viral protein is capable of self-assembling into a VLP;

wherein the one or more alterations enhance VLP production, and wherein the altered viral proteins of the VLP of claim 1 and the second VLP are from different alphaviruses.

7. A kit comprising the VLP of claim 1.

8. A method of introducing an agent into a cell comprising:

a. packaging the agent into an alphavirus VLP comprising at least one altered viral proteins selected from the group consisting of:

i. an alphavirus E2 protein comprising one or more alterations, relative to the wild-type amino acid sequence, at one or more amino acid location corresponding to one or more amino acid location selected from the group consisting of H170, K200, K233, K234, R251 and H256 of CHKV E2 protein; and ii. an alphavirus capsid protein comprising one or more alterations, relative to the wild-type amino acid sequence, at a charged amino acid residue in the Nuclear Localization Signal (NLS);

wherein the at least one altered viral protein is capable of self-assembling into a VLP; and wherein the one or more alterations enhance VLP production;

b. contacting a cell with the VLP under conditions that allow the VLP to enter the cell, thereby introducing the agent into the cell.

9. The method of claim 8, wherein the one or more altered viral protein(s) are derived from a virus selected from the group consisting of Eastern equine encephalitis virus (EEEV), Western equine encephalitis virus (WEEV), Venezuelan equine encephalitis virus (VEEV), Semliki Forest virus (SFV), Chikungunya virus (CHIKV), O'nyong-nyong virus, Sindbis virus, Mayaro virus, Ross River virus, Barmah Forest virus, and Ockelbo virus.

10. The method of claim 8, wherein the one or more alteration in a charged amino acid residue in the NLS is in at least one amino acid region selected from the group consisting of:

a. amino acids 67-70 of an EEEV capsid protein;

b. amino acids 67-70 of an WEEV capsid protein;

c. amino acids 64-68 of an VEEV capsid protein;

d. amino acids 62-69 of a CHIKV capsid protein;

e. amino acids 71-74 of a Ross River virus capsid protein; and f. amino acids 64-68 of a Barmah Forest virus capsid protein.

11. The VLP of claim 1, wherein the E2 protein comprising one or more alterations comprises an amino acid sequence selected from the group consisting of:

a) an amino acid sequence selected from the group consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 170 of SEQ ID NO:65 is not a histidine;

b) an amino acid sequence selected from the group consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 200 of SEQ ID NO:65 has been modified;

c) an amino acid sequence selected from the group consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 233 of SEQ ID NO:65 has been modified;

d) an amino acid sequence selected from the group consisting of consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 234 of SEQ ID NO:65 is not a lysine;

e) an amino acid sequence consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 251 of SEQ ID NO:65 has been modified; and, f) an amino acid sequence selected from the group consisting of SEQ ID NO:65, SEQ ID NO:66, SEQ ID NO:67, SEQ ID NO:68, SEQ ID NO:69, SEQ ID NO:70 and SEQ ID NO:71, wherein the amino acid at a position corresponding to position 256 of SEQ ID NO:65 is not a histidine;

wherein the E2 protein comprising one or more alterations can form a VLP.

12. The VLP of claim 11, wherein the wherein the amino acid at a position corresponding to position 234 of SEQ ID NO:65 is an asparagine.

13. The VLP of claim 1, wherein the capsid protein comprises an amino acid sequence selected from the group consisting of:

a) an amino acid sequence comprising SEQ ID NO:115 (WEEV), wherein the amino acid sequence is altered at one or more amino acid positions selected from the group consisting of amino acid position 67, amino acid position 68 and amino acid position 69;

b) an amino acid sequence comprising SEQ ID NO:124 (VEEV), wherein the amino acid sequence is altered at amino acid position 67;

c) an amino acid sequence comprising SEQ ID NO:142 (CHIKV), wherein the amino acid sequence is altered at one or more amino acid positions selected from the group consisting of amino acid position 62, amino acid position 63, amino acid position 65, amino acid position 66, amino acid position 68 and amino acid position 69;

d) an amino acid sequence comprising SEQ ID NO:154 (Ross River), wherein the amino acid sequence is altered at one or more amino acid positions selected from the group consisting of amino acid position 71, amino acid position 72, amino acid position 73 and amino acid position 74;

e) an amino acid sequence comprising SEQ ID NO:171 (BFV), wherein the amino acid sequence is altered at one or more amino acid position selected from the group consisting of amino acid position 64, amino acid position 65, amino acid position 67 and amino acid position 68.

14. The VLP of claim 1, wherein the capsid protein comprises an amino acid sequence selected from the group consisting of:

a) an amino acid sequence comprising SEQ ID NO:115 (WEEV), wherein the amino acid sequence comprises one or more alterations selected from the group consisting of K67N, K68N and K69N;

b) an amino acid sequence comprising SEQ ID NO:124 (VEEV), wherein the amino acid sequence comprises one or more alterations selected from the group consisting of K64N, K65A, K65N, K67A and K67N;

c) an amino acid sequence comprising SEQ ID NO:142 (CHIKV), wherein the amino acid sequence comprises one or more alterations selected from the group consisting of R62A, R63A, R65A, K66A, K68A and K69A;

d) an amino acid sequence comprising SEQ ID NO:154 (Ross River), wherein the amino acid sequence comprises one or more alterations selected from the group consisting of R71N, K72N, K73N and K74N; and, e) an amino acid sequence comprising SEQ ID NO:171 (BFV), wherein the amino acid sequence comprises one or more alterations selected from the group consisting of K64A, K64N, K65A, K65N, K67A, K67N, K68A and K68N.

15. The VLP of claim 1, wherein the capsid protein comprises an amino acid sequence selected from the group consisting of SEQ ID NO:115, SEQ ID NO:118, SEQ ID NO:121, SEQ ID NO:124, SEQ ID NO:127, SEQ ID NO:130, SEQ ID NO:133, SEQ ID NO:136, SEQ ID NO:139, SEQ ID NO:142, SEQ ID NO:145, SEQ ID NO:148, SEQ ID NO:151, SEQ ID NO:154, SEQ ID NO:157, SEQ ID NO:160, SEQ ID NO:163 and SEQ ID NO:171.

16. The VLP of claim 11, wherein the wherein the amino acid at a position corresponding to position 170 of SEQ ID NO:65 is a methionine.

17. The VLP of claim 11, wherein the wherein the amino acid at a position corresponding to position 200 of SEQ ID NO:65 is a lysine.

18. The VLP of claim 11, wherein the wherein the amino acid at a position corresponding to position 233 of SEQ ID NO:65 is an asparagine.

19. The VLP of claim 11, wherein the wherein the amino acid at a position corresponding to position 256 of SEQ ID NO:65 is a glutamine.

* * * * *